US011882808B2

(12) United States Patent
Miller

(10) Patent No.: US 11,882,808 B2
(45) Date of Patent: Jan. 30, 2024

(54) METHODS FOR IMPROVING RESISTANCE TO SOYBEAN RUST

(71) Applicant: Pairwise Plants Services, Inc., Durham, NC (US)

(72) Inventor: Marisa Miller, Durham, NC (US)

(73) Assignee: Pairwise Plants Services, Inc., Durham, NC (US)

( * ) Notice: Subject to any disclaimer, the term of this patent is extended or adjusted under 35 U.S.C. 154(b) by 161 days.

(21) Appl. No.: 17/212,686

(22) Filed: Mar. 25, 2021

(65) Prior Publication Data
US 2021/0301283 A1 Sep. 30, 2021

Related U.S. Application Data

(60) Provisional application No. 63/000,608, filed on Mar. 27, 2020.

(51) Int. Cl.
| | |
|---|---|
| *C12N 15/10* | (2006.01) |
| *A01H 6/54* | (2018.01) |
| *C12N 9/22* | (2006.01) |
| *C07K 14/41* | (2006.01) |
| *C07K 14/415* | (2006.01) |

(52) U.S. Cl.
CPC ........... *A01H 6/542* (2018.05); *C07K 14/415* (2013.01); *C12N 9/22* (2013.01); *C12N 15/102* (2013.01); *C12Y 499/01* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 2007/0094744 | A1 | 4/2007 | Paek |
| 2012/0278944 | A1 | 11/2012 | Wang et al. |

OTHER PUBLICATIONS

Wang et al., First Published Jul. 19, 2018, Staygreen, Stay Healthy: a loss-of-susceptibility mutation in the Staygreen gene provides durable, broad-spectrum disease resistances for over 50 years of US cucumber production. New Phytologist, 221(1), 415-430. (Year: 2018).*
USDA ARS GRIN-Global (https://www.ars-grin.gov/), Accessed 2/106/2023 (Year: 2023).*
Nakano et al., First published Date Aug. 9, 2014, A green-cotyledon/stay-green mutant exemplifies the ancient whole-genome duplications in soybean. Plant and Cell Physiology, 55(10), 1763-1771. (Year: 2014).*
Peng et al., 2017, Engineering canker-resistant plants through CRISPR/Cas9-targeted editing of the susceptibility gene Cs LOB 1 promoter in citrus. Plant biotechnology journal, 15(12), 1509-1519. (Year: 2017).*
Shi et al., 2016, GmSGR1, a stay-green gene in soybean (*Glycine max* L.), plays an important role in regulating early leaf-yellowing phenotype and plant productivity under nitrogen deprivation. Acta Physiologie Plantarum, 38, 1-14. (Year: 2016).*
Ishiga, 2015, Transcriptomic and metabolomic analyses identify a role for chlorophyll catabolismand phytoalexin during Medicago nonhost resistance against Asian soybean rust. Scientific reports, 5(1), 13061. (Year: 2015).*
NCBI Blast Search and alignment for SEQ ID No. 75, Accessed in Feb. 6, 2023 at https://www.ncbi.nlm.nih.gov/. (Year: 2023).*
NCBI Blast Search for SEQ ID No. 73. Accessed in Feb. 11, 2023 at https://www.ncbi.nlm.nih.gov/. (Year: 2023).*
NCBI Blast Search for SEQ ID No. 119. Accessed in Feb. 11, 2023 at https://www.ncbi.nlm.nih.gov/. (Year: 2023).*
NCBI Blast Search for SEQ ID No. 73, senescence-inducible chloroplast stay-green protein 1 [Glycine max]. Accessed in Feb. 14, 2023 at https://www.ncbi.nlm.nih.gov/. (Year: 2023).*
Guo et al., 2004, Protein tolerance to random amino acid change. Proceedings of the National Academy of Sciences, 101(25), 9205-9210. (Year: 2004).*
Rodríguez-Leal et al., 2017, Engineering quantitative trait variation for crop improvement by genome editing. Cell, 171(2), 470-480. (Year: 2017).*
Meaning of Gene knockdown, Integrated DNA technologies, https://www.idtdna.com/pages/applications/gene-knockdown, Accessed 06/25/25023. (Year: 2023).*
Alignment of SEQ ID No. 119 to NCBI Blast D2 gene. NCBI Blast, Global Alignment. Accessed Jun. 23, 2023 (Year: 2023).*

Alignment of SEQ ID No. 119 to NCBI SGR1 cds. NCBI Blast, Global Alignment. Accessed Jun. 23, 2023 (Year: 2023).*

Alignment of SEQ ID No. 119 to SEQ ID No. 75.NCBI Blast, Global Alignment. Accessed Jun. 23, 2023. (Year: 2023).*
Alignment of SEQ ID No. 119 to SEQ ID No. 77, NCBI Blast, Global Alignment. Accessed Jun. 23, 2023. (Year: 2023).*
Glycine max stay-green protein (SGR1) gene, locus HQ108342, complete cds—Nucleotide—NCBI Gene Bank. Accessed Jun. 22, 2023. (Year: 2023).*
Shin et al., 2020, Natural variations at the Stay-Green gene promoter control lifespan and yield in rice cultivars. Nature Communications, 11(1), 2819. (Year: 2020).*
Shin et al., 2020, Natural variations at the Stay-Green gene promoter control lifespan and yield in rice cultivars, Supplementary Information. Nature Communications, 11(1), 2819. (Year: 2020).*
Jiao et al., 2020, Roles of stay-green (SGR) homologs during chlorophyll degradation in green plants. Botanical studies, 61(1), 1-9. (Year: 2020).*
Mo et al., 2020, Utilization of elite Korean japonica rice varieties for association mapping of heading time, culm length, and amylose and protein content. The Korean Journal of Crop Science, 65(1), 1-21. (Year: 2020).*
International Search Report and Written Opinion corresponding to PCT/US2021/024281; dated Jul. 16, 2021 (17 pages).

(Continued)

*Primary Examiner* — Cathy Kingdon Worley
*Assistant Examiner* — Santosh Sharma
(74) *Attorney, Agent, or Firm* — Myers Bigel, P.A.

(57) ABSTRACT

This invention relates to compositions and methods for modifying STAYGREEN (SGR) genes in plants. The invention further relates to plants produced using the methods and compositions of the invention comprising modified endogenous SGR genes and having increased resistance to soybean rust.

2 Claims, 10 Drawing Sheets

Specification includes a Sequence Listing.

(56) References Cited

OTHER PUBLICATIONS

Genbank, "Cucumis sativus Stay-Green (dm1) gene, complete cds", Nucleotide—NCBI; MH493893 (2 pages).
Chang, Hao-Xun, et al., "Characterization of Soybean Stay-Green Genes in Susceptibility to Foliar Chlorosis of Sudden Death Syndrome", Plant Physiology 180(2); plus supplemental, 2019, 711-717.
Ishiga, Yasuhiro, et al., "Transcriptomic and metabolomic analyses identify a role for chlorophyll catabolismand phytoalexin during Medicago nonhost resistance against Asian soybean rust", Scientific Reports 5:13061, 2015.
Moore, John W., et al., "A recently evolved hexose transporter variant confers resistance to multiple pathogens in wheat", Nature Genetics 47(12), 2015, 1494-1498.
Pan, Junsong, et al., "Staygreen (CsSGR) is a candidate for the anthracnose (Colletotrichum orbiculare) resistance locus cla in Gy14 cucumber", Theor Appl Genet 131, 2018, 1577-1587.
Razzaq, Ali, et al., "Modern Trends in Plant Genome Editing: An Inclusive Review of the CRISPR/Cas9 Toolbox", Int. J. Mol. Sci. 20(16), 2019, 1-44.
Rodriguez-Leal, Daniel, et al., "Engineering Quantitative Trait Variation for Crop Improvement by Genome Editing", Cell 171(2), 2017, 470-480.e8.
Wang, Yuhui, et al., "Staygreen, Stay Healthy: a loss-of-susceptibility mutation in the Staygreen gene provides durable, broad-spectrum disease resistances for over 50 years of US cucumber production", New Phytologist 221(1), 2019, 415-430.

* cited by examiner

B

9 DPI
CONNECTING LETTERS REPORT

| LEVEL | | | | | MEAN |
|---|---|---|---|---|---|
| GM_PCE35816 | A | | | | 49.843750 |
| GM_PCE35906 | A | B | | | 47.450000 |
| GM_PCE35842 | A | B | | | 47.300000 |
| GM_PCE39930 | | B | | | 46.475000 |
| PI548167 | | B | | | 46.328125 |
| GM_PCE35914 | | B | C | | 45.387500 |
| GM_PCE35706 | | B | C | D | 45.012500 |
| GM_PCE35915 | | | C | D | 43.271875 |
| NON-TRANSFORMED CONTROL | | | C | D | 43.084375 |
| GM_PCE40104 | | | | D | 42.771875 |

LEVELS NOT CONNECTED BY SAME
LETTER ARE SIGNIFICANTLY DIFFERENT.

11 DPI
CONNECTING LETTERS REPORT

| LEVEL | | | | | MEAN |
|---|---|---|---|---|---|
| PI548167 | A | | | | 46.696875 |
| GM_PCE35816 | A | B | | | 43.893750 |
| GM_PCE35842 | | B | C | | 42.103125 |
| GM_PCE39930 | | B | C | | 41.656250 |
| GM_PCE35906 | | B | C | D | 40.865625 |
| GM_PCE35706 | | | C | D | 39.756250 |
| GM_PCE40104 | | | | D | E | 36.771875 |
| GM_PCE35914 | | | | D | E | 36.128125 |
| GM_PCE35915 | | | | | E | 35.334375 |
| NON-TRANSFORMED CONTROL | | | | | E | 34.050000 |

LEVELS NOT CONNECTED BY SAME
LETTER ARE SIGNIFICANTLY DIFFERENT.

14 DPI
CONNECTING LETTERS REPORT

| LEVEL | | | | | MEAN |
|---|---|---|---|---|---|
| PI548167 | A | | | | 44.228125 |
| GM_PCE35816 | | B | C | | 35.659375 |
| GM_PCE35706 | | B | C | | 34.968750 |
| GM_PCE35842 | | B | C | | 34.853125 |
| GM_PCE39930 | | B | C | D | 34.328125 |
| GM_PCE35906 | | | C | D | 32.137500 |
| GM_PCE40104 | | | | D | E | 29.400000 |
| GM_PCE35914 | | | | D | E | 27.403125 |
| GM_PCE35915 | | | | | E | 25.214286 |
| NON-TRANSFORMED CONTROL | | | | | E | 23.946875 |

LEVELS NOT CONNECTED BY SAME
LETTER ARE SIGNIFICANTLY DIFFERENT.

** SIGNIFICANCE AT 0.05

*FIG. 6 (CONT.)*

METHODS FOR IMPROVING RESISTANCE TO SOYBEAN RUST

STATEMENT REGARDING ELECTRONIC FILING OF A SEQUENCE LISTING

A Sequence Listing in ASCII text format, submitted under 37 C.F.R. § 1.821, entitled 1499.31_ST25.txt, 676,680 bytes in size, generated on Mar. 23, 2021 and filed via EFS-Web, is provided in lieu of a paper copy. This Sequence Listing is hereby incorporated herein by reference into the specification for its disclosures.

STATEMENT OF PRIORITY

This application claims the benefit, under 35 U.S.C. § 119 (e), of U.S. Provisional Application No. 63/000,608 filed on Mar. 27, 2020, the entire contents of which is incorporated by reference herein.

FIELD OF THE INVENTION

This invention relates to compositions and methods for modifying STAYGREEN (SGR) genes in plants. The invention further relates to plants produced using the methods and compositions of the invention comprising modified endogenous SGR genes and having increased resistance to soybean rust.

BACKGROUND OF THE INVENTION

Fungicides are the most common method of control for soybean rust; however, various genetic resistance mechanisms are also currently employed. The most commonly utilized genes are single resistance genes called Rpp loci. These genes confer race-specific resistance and do not provide protection against global collections of isolates.

Fungicides generally are subject to resistance development by pathogens and typically become less effective over time. Similarly, Rpp genes are prone to resistance breakdown, in some cases before a commercial crop comprising the trait can even be launched. Soybean rust fungi have complex life cycles with multiple asexual (clonal) cycles per growing season, which likely contributes to high levels of genetic diversity and the rapid evolution of virulence in the pathogen. Therefore, race-specific resistance is not a durable solution.

Novel strategies for introducing improved resistance to soybean rust are needed to improve crop performance.

SUMMARY OF THE INVENTION

One aspect of the invention provides a plant or plant part thereof comprising at least one non-natural mutation in an endogenous STAYGREEN (SGR) gene that encodes an SGR protein.

A second aspect of the invention provides a plant cell, comprising an editing system comprising: (a) a CRISPR-Cas effector protein; and (b) a guide nucleic acid (gRNA, gDNA, crRNA, crDNA, sgRNA, sgDNA) comprising a spacer sequence with complementarity to an endogenous target gene encoding a SGR protein.

A third aspect of the invention provides a soybean plant cell comprising at least one non-natural mutation within an SGR gene, wherein the mutation is a substitution, insertion or a deletion that is introduced using an editing system that comprises a nucleic acid binding domain that binds to a target site in the SGR gene.

A fourth aspect of the invention provides a method of producing/breeding a transgene-free edited soybean plant, comprising: crossing the soybean plant of the invention with a transgene free soybean plant, thereby introducing the at least one non-natural mutation into the soybean plant that is transgene-free; and selecting a progeny soybean plant that comprises the at least one non-natural mutation and is transgene-free, thereby producing a transgene free edited soybean plant.

A fifth aspect of the invention provides a method of providing a plurality of soybean plants having increased resistance to soybean rust (e.g., *Phakopsora pachyrhizi* (Asian soybean rust and *Phakopsora meibomiae* (New World soybean rust)), the method comprising planting two or more plants of the invention in a growing area (e.g., a field (e.g., a cultivated field, an agricultural field), a growth chamber, a greenhouse, a recreational area, a lawn, and/or a roadside and the like), thereby providing a plurality of soybean plants having increased resistance to soybean cyst nematode as compared to a plurality of control soybean plants not comprising the mutation.

A sixth aspect of the invention provides a method for editing a specific site in the genome of a soybean plant cell, the method comprising: cleaving, in a site-specific manner, a target site within an endogenous SGR gene in the soybean plant cell, wherein the endogenous SGR gene ((a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby generating an edit in an endogenous SGR gene of the soybean plant cell and producing a plant cell comprising the edit in an endogenous SGR gene.

A seventh aspect provides a method for making a soybean plant, comprising: (a) contacting a population of soybean plant cells comprising at least one wild type endogenous SGR gene with a nuclease linked to a nucleic acid binding domain (e.g., a DNA binding domain; e.g., an editing system) that binds to a target site in the at least one wild type endogenous SGR gene, the wild type endogenous SGR gene (i) comprising a sequence having at least 90% sequence identity to the nucleotide sequence of SEQ ID NO:81 or SEQ ID NO:82; (ii) comprising a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (iii) encoding a polypeptide sequence (1) having at least 95% sequence identity to the amino acid sequence of SEQ ID NO:73 or SEQ ID NO:74; and/or (2) comprising a region having at least 90% sequence identity to any one of the amino acid sequences of SEQ ID NOs:83-89; (b) selecting a plant cell from said population in which at least one wild type endogenous SGR gene has been mutated; and (c) growing the selected soybean plant cell into a soybean plant having a mutation in an endogenous SGR gene.

An eighth aspect provides a method for increasing soybean rust resistance in a soybean plant or part thereof, comprising (a) contacting a soybean plant cell comprising a wild type endogenous SGR gene with a nuclease targeting the wild type endogenous SGR gene, wherein the nuclease is linked to a nucleic acid binding domain that binds to a target site in the wild type endogenous SGR gene, wherein the wild type endogenous SGR gene: (i) comprises a sequence having at least 90% sequence identity to the nucleotide sequence of SEQ ID NO:81 or SEQ ID NO:82; (ii) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (iii) encodes a polypeptide sequence (1) having at least 95% sequence identity to the amino acid sequence of SEQ ID NO:73 or SEQ ID NO:74; and/or (2) comprising a region having at least 90% sequence identity to any one of the amino acid sequences of SEQ ID NOs:83-89, thereby producing a plant cell comprising a mutation in the wild type endogenous SGR gene; and (b) growing the plant cell into a plant comprising the mutation in the wild type endogenous SGR gene, thereby increasing soybean rust resistance in a soybean plant or part thereof.

A ninth aspect provides a method for producing a soybean plant or part thereof comprising at least one cell having a mutated endogenous SGR gene, the method comprising contacting a target site in an endogenous SGR gene in the soybean plant or plant part with a nuclease comprising a cleavage domain and a nucleic acid binding domain, wherein the nucleic acid binding domain binds to a target site in the endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby producing a plant cell comprising a mutation in the wild type endogenous SGR gene, thereby producing the soybean plant or part thereof comprising at least one cell having a mutation in the endogenous SGR gene.

A tenth aspect provides a method for producing a soybean plant or part thereof comprising a mutation in an endogenous SGR gene and exhibiting increased resistance to soybean rust, the method comprising contacting a target site in an endogenous SGR gene in the soybean plant or plant part with a nuclease comprising a cleavage domain and a nucleic acid binding domain, wherein the nucleic acid binding domain binds to a target site in the endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby producing the soybean plant or part thereof comprising an endogenous SGR gene having a mutation and exhibiting increased resistance to soybean rust.

An eleventh aspect provides a guide nucleic acid that binds to a target site in an endogenous SGR gene, the target site comprising a sequence having at least 90% sequence identity to a region in the SGR gene, the SGR gene (a) comprising a sequence having at least 90% sequence identity to the nucleotide sequence of SEQ ID NO:81 or SEQ ID NO:82; (a) having at least 90% sequence identity to any one of the nucleotide sequences of SEQ ID NOs:75-80; and/or (b) encoding a polypeptide sequence: (i) having at least 95% sequence identity to the amino acid sequence of SEQ ID NO:73 or SEQ ID NO:74; (ii) comprising a region having at least 90% sequence identity to any one of the amino acid sequences of SEQ ID NOs:83-89, thereby producing the soybean plant or part thereof comprising an endogenous SGR gene having a mutation and exhibiting increased resistance to soybean rust.

A twelfth aspect provides a system is provided comprising a guide nucleic acid of the invention and a CRISPR-Cas effector protein that associates with the guide nucleic acid.

A thirteenth aspect provides a gene editing system comprising a CRISPR-Cas effector protein in association with a guide nucleic acid, wherein the guide nucleic acid comprises a spacer sequence that binds to an endogenous SGR gene.

In fourteenth aspect, a complex comprising a guide nucleic acid and a CRISPR-Cas effector protein comprising a cleavage domain, wherein the guide nucleic acid binds to a target site in an endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, wherein the cleavage domain cleaves a target strand in the SGR gene.

In fifteenth aspect an expression cassette is provided, the expression cassette comprising (a) a polynucleotide encoding CRISPR-Cas effector protein comprising a cleavage domain and (b) a guide nucleic acid that binds to a target site in an endogenous SGR gene, wherein the guide nucleic acid comprises a spacer sequence that is complementary to and binds to a portion of a sequence (a) having at least 90% sequence identity to the nucleotide sequences of SEQ ID NOs:75-80, (b) encoding a sequence having at least 95% sequence identity to any one of the amino acid sequences of SEQ ID NOs:72-74 or 83-89; and/or encoded by a by a sequence having at least 90% sequence identity to the nucleotide sequence of SEQ ID NO:81 or SEQ ID NO:82.

A further aspect of the invention provides a nucleic acid encoding a semi-dominant mutation of a soybean SGR protein.

In an additional aspect, a soybean plant or part thereof is provided comprising a nucleic acid of the invention.

In a further aspect, a soybean plant or part thereof is provided comprising increased resistance to soybean rust.

Further provided are plants comprising in their genomes one or more mutated SGR genes produced by the methods of the invention as well as polypeptides, polynucleotides, nucleic acid constructs, expression cassettes and vectors for making a plant of this invention.

These and other aspects of the invention are set forth in more detail in the description of the invention below.

BRIEF DESCRIPTION OF THE SEQUENCES

SEQ ID NOs:1-17 are exemplary Cas12a amino acid sequences useful with this invention.

SEQ ID NOs:18-20 are exemplary Cas12a nucleotide sequences useful with this invention.

SEQ ID NO:21-22 are exemplary regulatory sequences encoding a promoter and intron.

SEQ ID NOs:23-29 are exemplary cytosine deaminase sequences useful with this invention.

SEQ ID NOs:30-40 are exemplary adenine deaminase amino acid sequences useful with this invention.

SEQ ID NO:41 is an exemplary uracil-DNA glycosylase inhibitor (UGI) sequences useful with this invention.

SEQ ID NOs:42-44 provides an example of a protospacer adjacent motif position for a Type V CRISPR-Cas12a nuclease.

SEQ ID NOs:45-47 provide example peptide tags and affinity polypeptides useful with this invention.

SEQ ID NOs:48-58 provide example RNA recruiting motifs and corresponding affinity polypeptides useful with this invention.

SEQ ID NOs:59-60 are exemplary Cas9 polypeptide sequences useful with this invention.

SEQ ID NOs:61-71 are exemplary Cas9 polynucleotide sequences useful with this invention.

SEQ ID NOs:72-74 are example SGR polypeptide sequences.

SEQ ID NO:75 and SEQ ID NO:76 are example polynucleotide sequences comprising untranslated regions of SGR1 and SGR2 genes, respectively, including the promoter region.

SEQ ID NO:77 and SEQ ID NO:78 are example polynucleotide sequences comprising genomic transcript sequences (pre-mRNA) of SGR1 and SGR2, respectively.

SEQ ID NO:79 and SEQ ID NO:80 are example mRNA sequences of SGR1 and SGR2, respectively.

SEQ ID NO:81 and SEQ ID NO:82 are example coding sequences (cDNAs) of SGR1 and SGR2, respectively, encoding SEQ ID NO:75 and SEQ ID NO:76, respectively.

SEQ ID NOs:83-89 provide portions of SGR polynucleotide sequences (e.g., SEQ ID NO:73 and SEQ ID NO:74).

SEQ ID NOs:90-114 are example spacer sequences for nucleic acid guides useful with this invention.

SEQ ID NOs:115-144 are example edited endogenous SGR nucleic acid sequences as shown in Table 1.

SEQ ID NOs:145-146 are wild type (WT) SGR1 and SGR2 genes.

DETAILED DESCRIPTION

Figure 1:
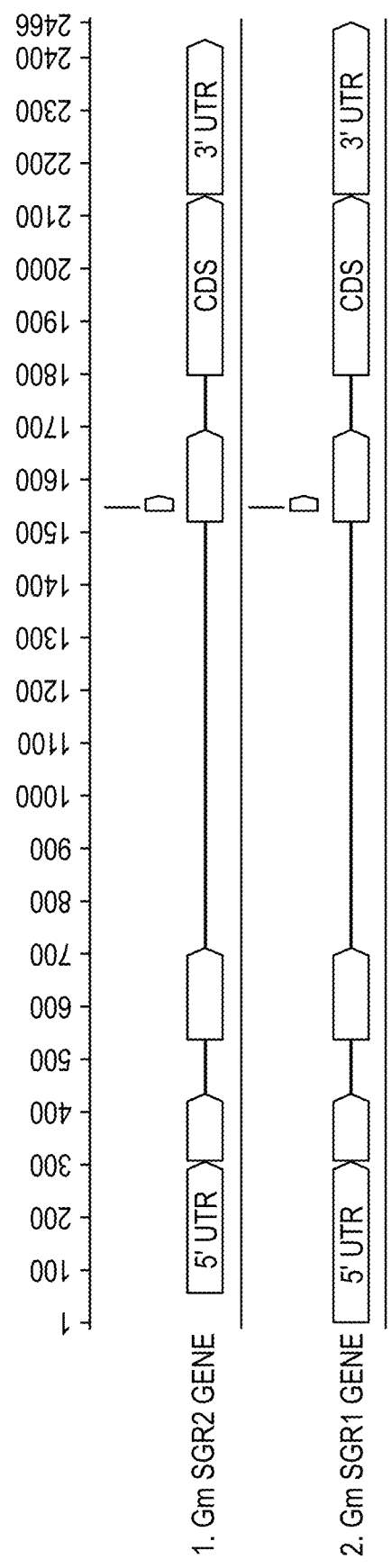
FIG. 1 provides exemplary target regions in SGR1 and SGR2 with example spacer sequences for use with guide nucleic acids.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of 10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "increased," "enhance," "enhanced," "enhancing," and "enhancement" (and grammatical variations thereof) describe an elevation of at least about 5%, 10%, 15%, 20%, 25%, 50%, 75%, 100%, 150%, 200%, 300%, 400%, 500% or more as compared to a control. For example, a plant comprising a mutation in a SGR gene as described herein can exhibit increased resistance (or decreased susceptibility) to soybean rust (e.g., *Phakopsora pachyrhizi* (Asian soybean rust and *Phakopsora meibomiae* (New World soybean rust)), that is at least about 5% greater resistance than that of a plant not comprising the same mutation.

As used herein, the terms "reduce," "reduced," "reducing," "reduction," "diminish," and "decrease" (and grammatical variations thereof), describe, for example, a decrease of at least about 5%, 10, 1%, 20%, 25%, 35%, 50%, 75%, 80%, 85%, 90%, 95%, 96%, 97%, 98%, 99%, 99.5%, 99.6%, 99.7%, 99.8%, 99.9%, or 100% as compared to a control. In particular embodiments, the reduction can result in no or essentially no (i.e., an insignificant amount, e.g., less than about 10% or even 5%) detectable activity or amount.

As used herein, the terms "express," "expresses," "expressed" or "expression," and the like, with respect to a nucleic acid molecule and/or a nucleotide sequence (e.g., RNA or DNA) indicates that the nucleic acid molecule and/or a nucleotide sequence is transcribed and, optionally, translated. Thus, a nucleic acid molecule and/or a nucleotide sequence may express a polypeptide of interest or, for example, a functional untranslated RNA.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type endogenous SGR gene" is a SGR gene that is naturally occurring in or endogenous to the reference organism, e.g., a soybean plant.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "allele" refers to one of two or more different nucleotides or nucleotide sequences that occur at a specific locus.

A "null allele" is a nonfunctional allele caused by a genetic mutation that results in a complete lack of production of the corresponding protein or produces a protein that is nonfunctional.

A "dominant negative mutation" is a mutation that produces an altered gene product (e.g., having an aberrant function relative to wild type), which gene product adversely affects the function of the wild-type allele or gene product. For example, a "dominant negative mutation" may block a function of the wild type gene product. A dominant negative mutation may also be referred to as an "antimorphic mutation."

A "semi-dominant mutation" refers to a mutation in which the penetrance of the phenotype in a heterozygous organism is less than that observed for a homozygous organism.

A "weak loss-of-function mutation" is a mutation that results in a gene product having partial function or reduced function (partially inactivated) as compared to the wildtype gene product.

A "hypomorphic mutation" is a mutation that results in a partial loss of gene function, which may occur through reduced expression (e.g., reduced protein and/or reduced RNA) or reduced functional performance (e.g., reduced activity), but not a complete loss of function/activity. A "hypomorphic" allele is a semi-functional allele caused by a genetic mutation that results in production of the corresponding protein that functions at anywhere between 1% and 99% of normal efficiency.

A "locus" is a position on a chromosome where a gene or marker or allele is located. In some embodiments, a locus may encompass one or more nucleotides.

As used herein, the terms "desired allele," "target allele" and/or "allele of interest" are used interchangeably to refer to an allele associated with a desired trait. In some embodiments, a desired allele may be associated with either an increase or a decrease (relative to a control) of or in a given trait, depending on the nature of the desired phenotype.

A marker is "associated with" a trait when said trait is linked to it and when the presence of the marker is an indicator of whether and/or to what extent the desired trait or trait form will occur in a plant/germplasm comprising the marker. Similarly, a marker is "associated with" an allele or chromosome interval when it is linked to it and when the presence of the marker is an indicator of whether the allele or chromosome interval is present in a plant/germplasm comprising the marker.

As used herein, the terms "backcross" and "backcrossing" refer to the process whereby a progeny plant is crossed back to one of its parents one or more times (e.g., 1, 2, 3, 4, 5, 6, 7, 8, etc.). In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. *Marker-assisted Backcrossing: A Practical Example*, in TECHNIQUES ET UTILISATIONS DES MARQUEURS MOLECULAIRES LES COLLOQUES, Vol. 72, pp. 45-56 (1995); and Openshaw et al., *Marker-assisted Selection in Backcross Breeding*, in PROCEEDINGS OF THE SYMPOSIUM "ANALYSIS OF MOLECULAR MARKER DATA," pp. 41-43 (1994). The initial cross gives rise to the F1 generation. The term "BC1" refers to the second use of the recurrent parent, "BC2" refers to the third use of the recurrent parent, and so on.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be backcrossed one or more times (e.g., 1, 2, 3, 4, or more times) to a line having a desired genetic background, selecting for the desired allele, with the result being that the desired allele becomes fixed in the desired genetic background. For example, a marker associated with increased yield under non-water stress conditions may be introgressed from a donor into a recurrent parent that does not comprise the marker and does not exhibit increased yield under non-water stress conditions. The resulting offspring could then be backcrossed one or more times and selected until the progeny possess the genetic marker(s) associated with increased yield under non-water stress conditions in the recurrent parent background.

A "genetic map" is a description of genetic linkage relationships among loci on one or more chromosomes within a given species, generally depicted in a diagrammatic or tabular form. For each genetic map, distances between loci are measured by the recombination frequencies between them. Recombination between loci can be detected using a variety of markers. A genetic map is a product of the mapping population, types of markers used, and the polymorphic potential of each marker between different populations. The order and genetic distances between loci can differ from one genetic map to another.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific genetic makeup that provides a foundation for some or all of the hereditary qualities of an organism or cell culture. As used herein, germplasm includes cells, seed or tissues from which new plants may be grown, as well as plant parts that can be cultured into a whole plant (e.g., leaves, stems, buds, roots, pollen, cells, etc.).

As used herein, the terms "cultivar" and "variety" refer to a group of similar plants that by structural or genetic features and/or performance can be distinguished from other varieties within the same species.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

As used herein, the term "hybrid" in the context of plant breeding refers to a plant that is the offspring of genetically dissimilar parents produced by crossing plants of different lines or breeds or species, including but not limited to the cross between two inbred lines.

As used herein, the term "inbred" refers to a substantially homozygous plant or variety. The term may refer to a plant or plant variety that is substantially homozygous throughout the entire genome or that is substantially homozygous with respect to a portion of the genome that is of particular interest.

A "haplotype" is the genotype of an individual at a plurality of genetic loci, i.e., a combination of alleles. Typically, the genetic loci that define a haplotype are physically and genetically linked, i.e., on the same chromosome segment. The term "haplotype" can refer to polymorphisms at a particular locus, such as a single marker locus, or polymorphisms at multiple loci along a chromosomal segment.

As used herein, the term "heterologous" refers to a nucleotide/polypeptide that originates from a foreign species, or, if from the same species, is substantially modified from its native form in composition and/or genomic locus by deliberate human intervention.

Asian soybean rust is a fungal disease caused by the obligate biotrophic pathogen *Phakopsora pachyrhizi* and New World soybean rust is a fungal disease caused by the obligate biotrophic pathogen *Phakopsora meibomiae*. These soybean rust pathogens can infect a wide-range of leguminous plant species. There are currently no effective resistance genes in *Glycine max* due to rapid loss of resistance conferred by race-specific Rpp genes. As such, partial or quantitative resistance mechanisms are seen as a more durable approach to addressing soybean rust disease.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "nucleic acid construct," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein with respect to nucleic acids, the term "fragment" or "portion" refers to a nucleic acid that is reduced in length relative (e.g., reduced by 1, 2, 3, 4, 5, 6, 7, 8, 9, 10, 11, 12, 13, 14, 15, 16, 17, 18, 19, 20, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 400, 450, 500, 550, 600, 650, 700, 750, 800, 850, or 900 or more nucleotides or any range or value therein) to a reference nucleic acid and that comprises, consists essentially of and/or consists of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to a corresponding portion of the reference nucleic acid. Such a nucleic acid fragment may be, where appropriate, included in a larger polynucleotide of which it is a constituent. As an example, a repeat sequence of guide nucleic acid of this invention may comprise a "portion" of a wild type CRISPR-Cas repeat sequence (e.g., a wild Type CRISR-Cas repeat; e.g., a repeat from the CRISPR Cas system of, for example, a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or a Cas14c, and the like). In some embodiments, a nucleic acid fragment may comprise, consist essentially of or consist of about 20, 25, 30, 35, 40, 45, 50, 55, 60, 65, 70, 75, 80, 85, 90, 95, 100, 125, 150, 175, 200, 225, 250, 300, 350, 400, 450, 500, 550, 600, 650, 700, 750, 800, 850, 900, 1000, 1500, 2000, 2100, 2200, 2216, 2220, 2230, 2240, 2250, 2260, 2270, 2280, 2290, 2295, 2296, 2297, 2298, 2299 2300, 2310, 2350, 2375 or 2400, or more consecutive nucleotides or any range or value therein of a nucleic acid encoding an SGR polynucleotide, optionally a fragment of an SGR gene may be about 50 nucleotides to about 300 nucleotides in length, about 50 nucleotides to about 350 nucleotides in length, about 50 nucleotides to about 400 nucleotides in length, about 50 nucleotides to about 450 nucleotides in length, about 50 nucleotides to about 500 nucleotides in length, about 50 nucleotides to about 600 nucleotides in length, about 50 nucleotides to about 800 nucleotides in length, about 50 nucleotides to about 900 nucleotides in length, about 50 nucleotides to about 950 nucleotides in length, about 100 nucleotides to about 300 nucleotides in length, about 100 nucleotides to about 350 nucleotides in length, about 100 nucleotides to about 400 nucleotides in length, about 100 nucleotides to about 450 nucleotides in length, about 100 nucleotides to about 500 nucleotides in length, about 100 nucleotides to about 600 nucleotides in length, about 100 nucleotides to about 800 nucleotides in length, about 100 nucleotides to about 900 nucleotides in length, or about 100 nucleotides to about 950 nucleotides in length, about 500 nucleotides to about 1000 nucleotides in length, about 500 nucleotides to about 1250 nucleotides in length, about 500 nucleotides to about 1500 nucleotides in length, about 500 nucleotides to about 1750 nucleotides in length, about 500 nucleotides to about 2000 nucleotides in length, about 500 nucleotides to about 2200 nucleotides in length, about 500 nucleotides to about 2250 nucleotides in length, about 500 nucleotides to about 2300 nucleotides in length, or about 500 nucleotides to about 2400 nucleotides in length, about 1000 nucleotides to about 1650 nucleotides in length, about 1000 nucleotides to about 1675 nucleotides in length, about 1000 nucleotides to about 1750 nucleotides in length, about 1000 nucleotides to about 1760 nucleotides in length, about 1000 nucleotides to about 2000 nucleotides in length, about 1000 nucleotides to about 2200 nucleotides in length, about 1000 nucleotides to about 2220 nucleotides in length, about 1000 nucleotides to about 2255 nucleotides in length, or about 1000 nucleotides to about 2300 nucleotides in length, or any range or value therein. In some embodiments, a nucleic acid fragment of a SGR gene may be the result of a deletion of nucleotides from the 3' end/region, the 5' end/region, and/or from within the gene encoding the SGR gene. In some embodiments, a deletion of a portion of an SGR nucleic acid comprises a deletion of a portion of consecutive nucleotides from the 3' region of, for example, the nucleotide sequence of SEQ ID NO:75 or SEQ ID NO:76 or a portion of consecutive nucleotides from the 5' end of the nucleotide sequence of SEQ ID NO:77 or SEQ ID NO:78. In some embodiments, such a deletion may be a point mutation, which when comprised in a plant can result in a plant having increased resistance to soybean rust. In some embodiments, such a deletion may be a semi-dominant mutation, which when comprised in a plant can result in a plant having increased resistance to soybean rust (as compared to a plant not comprising the mutation or as compared to a wild type isogenic plant not comprising the mutation).

A "region" of a polynucleotide or a polypeptide refers to a portion of consecutive nucleotides or consecutive amino acid residues of that polynucleotide or a polypeptide. For example, a region of a polynucleotide sequence may be consecutive nucleotides 1000 to 2298 or 1000 to 2216 of the nucleotide sequences of SEQ ID NO:75 and SEQ ID NO:76, respectively, or for example a region of a polypeptide sequence may be consecutive amino acid residues 31 to 123 or 90 to 130 of the amino acid sequence of SEQ ID NO:73.

As used herein with respect to polypeptides, the term "fragment" or "portion" may refer to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400 or more consecutive amino acids of a reference polypeptide.

In some embodiments, a "portion" may be related to the number of amino acids that are deleted from a polypeptide. Thus, for example, a deleted "portion" of an SGR polypeptide may comprise at least one amino acid residue (e.g., at least 1, or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 261, 265, 270, or 271 or more consecutive amino acid residues) deleted from any one of the amino acid sequences of SEQ ID NOs:72-74 (or from a sequence having at least 95% sequence identity to any one of the amino acid sequences of SEQ ID NOs:72-74). In some embodiments, a deleted portion of an SGR polypeptide may be an in-frame mutation in which at least one amino acid is deleted. In some embodiments, such a deletion may be a semi-dominant mutation and/or an in-frame mutation, which when comprised in a plant can result in the plant exhibiting increased resistance to soybean rust as compared to a plant not comprising said dominant negative mutation.

In some embodiments, a "sequence-specific nucleic acid binding domain" or "sequence-specific DNA binding domain" may bind to one or more fragments or portions of nucleotide sequences encoding SGR polypeptides (e.g., SEQ ID NOs:77-82) or to the untranslated regions of SGR genomic sequences as described herein (e.g., SEQ ID NO:75 or SEQ ID NO:76).

As used herein with respect to nucleic acids, the term "functional fragment" refers to nucleic acid that encodes a functional fragment of a polypeptide.

The term "gene," as used herein, refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue. A truncation can include a truncation at the C-terminal end of a polypeptide or at the N-terminal end of a polypeptide. A truncation of a polypeptide can be the result of a deletion of the corresponding 5' end or 3' end of the gene encoding the polypeptide.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement," as used herein, can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity) to the comparator nucleotide sequence.

Different nucleic acids or proteins having homology are referred to herein as "homologues." The term homologue includes homologous sequences from the same and from other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent sequence identity" can refer to the percentage of identical amino acids in an amino acid sequence as compared to a reference polypeptide.

As used herein, the phrase "substantially identical," or "substantial identity" in the context of two nucleic acid molecules, nucleotide sequences, or polypeptide sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, about 100 nucleotides to about 200 nucleotides, about 100 nucleotides to about 300 nucleotides, about 100 nucleotides to about 400 nucleotides, about 100 nucleotides to about 500 nucleotides, about 100 nucleotides to about 600 nucleotides, about 100 nucleotides to about 800 nucleotides, about 100 nucleotides to about 900 nucleotides, or more in length, or any range therein, up to the full length of the sequence. In some embodiments, nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40, 50, 60, 70, or 80 nucleotides or more).

In some embodiments of the invention, the substantial identity exists over a region of consecutive amino acid residues of a polypeptide of the invention that is about 3 amino acid residues to about 20 amino acid residues, about 5 amino acid residues to about 25 amino acid residues, about 7 amino acid residues to about 30 amino acid residues, about 10 amino acid residues to about 25 amino acid residues, about 15 amino acid residues to about 30 amino acid residues, about 20 amino acid residues to about 40 amino acid residues, about 25 amino acid residues to about 40 amino acid residues, about 25 amino acid residues to about 50 amino acid residues, about 30 amino acid residues to about 50 amino acid residues, about 40 amino acid residues to about 50 amino acid residues, about 40 amino acid residues to about 70 amino acid residues, about 50 amino acid residues to about 70 amino acid residues, about 60 amino acid residues to about 80 amino acid residues, about 70 amino acid residues to about 80 amino acid residues, about 90 amino acid residues to about 100 amino acid residues, or more amino acid residues in length, and any range therein, up to the full length of the sequence. In some embodiments, polypeptide sequences can be substantially identical to one another over at least about 8 consecutive amino acid residues (e.g., about 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 130, 140, 150, 175, 200, 225, 250, 300, 350 or more amino acids in length or more consecutive amino acid residues). In some embodiments, two or more SGR polypeptides may be identical or substantially identical (e.g., at least 70% to 99.9% identical; e.g. about 70%, 71%, 72%, 73%, 74%, 75%, 76%, 77%, 78%, 79%, 80%, 81%, 82%, 83%, 84%, 85%, 86%, 87%, 88%, 89%9, 90%, 91%, 92%, 93%, 94%, 95%, 96%, 97%, 98%, 99%, 99.5%. 99.9% identical or any range or value therein).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

A polynucleotide and/or recombinant nucleic acid construct of this invention (e.g., expression cassettes and/or vectors) may be codon optimized for expression. In some embodiments, the polynucleotides, nucleic acid constructs, expression cassettes, and/or vectors of the editing systems of the invention (e.g., comprising/encoding a sequence-specific nucleic acid binding domain (e.g., a sequence-specific DNA binding domain from a polynucleotide-guided endonuclease, a zinc finger nuclease, a transcription activator-like effector nuclease (TALEN), an Argonaute protein, and/or a CRISPR-Cas endonuclease (e.g., CRISPR-Cas effector protein) (e.g., a Type I CRISPR-Cas effector protein, a Type II CRISPR-Cas effector protein, a Type III CRISPR-Cas effector protein, a Type IV CRISPR-Cas effector protein, a Type V CRISPR-Cas effector protein or a Type VI CRISPR-Cas effector protein)), a nuclease (e.g., an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN)), deaminase proteins/domains (e.g., adenine deaminase, cytosine deaminase), a polynucleotide encoding a reverse transcriptase protein or domain, a polynucleotide encoding a 5'-3' exonuclease polypeptide, and/or affinity polypeptides, peptide tags, etc.) may be codon optimized for expression in a plant. In some embodiments, the codon optimized nucleic acids, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% or 100%) identity or more to the reference nucleic acids, polynucleotides, expression cassettes, and/or vectors that have not been codon optimized.

In any of the embodiments described herein, a polynucleotide or nucleic acid construct of the invention may be operatively associated with a variety of promoters and/or other regulatory elements for expression in a plant and/or a cell of a plant. Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron maybe referred to as a "promoter region" (e.g., Ubi1 promoter and intron).

By "operably linked" or "operably associated" as used herein in reference to polynucleotides, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a chemical group, or a molecule linking two molecules or moieties, e.g., two domains of a fusion protein, such as, for example, a nucleic acid binding polypeptide or domain and peptide tag and/or a reverse transcriptase and an affinity polypeptide that binds to the peptide tag; or a DNA endonuclease polypeptide or domain and peptide tag and/or a reverse transcriptase and an affinity polypeptide that binds to the peptide tag. A linker may be comprised of a single linking molecule or may comprise more than one linking molecule. In some embodiments, the linker can be an organic molecule, group, polymer, or chemical moiety such as a bivalent organic moiety. In some embodiments, the linker may be an amino acid or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g. extension of the hairpin structure in the guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in *Genetic Engineering of Plants*, T. Kosuge, C. Meredith and A. Hollaender (eds.), Plenum Press, pp. 211-227).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. Gene 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. Gene 403:132-142 (2007)) and Pdca1 is induced by salt (Li et al. *Mol Biol. Rep.* 37:1143-1154 (2010)). In some embodiments, a promoter useful with this invention is RNA polymerase II (Pol II) promoter. In some embodiments, a U6 promoter or a 7SL promoter from *Zea mays* may be useful with constructs of this invention. In some embodiments, the U6c promoter and/or 7SL promoter from *Zea mays* may be useful for driving expression of a guide nucleic acid. In some embodiments, a U6c promoter, U6i promoter and/or 7SL promoter from *Glycine max* may be useful with constructs of this invention. In some embodiments, the U6c promoter, U6i promoter and/or 7SL promoter from *Glycine max* may be useful for driving expression of a guide nucleic acid.

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) Nature 313:810-812), CaMV 19S promoter (Lawton et al. (1987) *Plant Mol. Biol.* 9:315-324), nos promoter (Ebert et al. (1987) Proc. Natl. Acad. Sci USA 84:5745-5749), Adh promoter (Walker et al. (1987) *Proc. Natl. Acad. Sci. USA* 84:6624-6629), sucrose synthase promoter (Yang & Russell (1990) Proc. Natl. Acad. Sci. USA 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as 0-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, herein incorporated by reference in its entirety. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); EP 0 452 269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS 11 from rice (Nguyen et al. *Plant Biotechnol. Reports* 9(5):297-306 (2015)), ZmSTK2_USP from maize (Wang et al. *Genome* 60(6):485-495 (2017)), LAT52 and LAT59 from tomato (Twell et al. *Development* 109(3):705-713 (1990)), Zm13 (U.S. Pat. No. 10,421,972), PLA$_2$-δ promoter from *arabidopsis* (U.S. Pat. No. 7,141,424), and/or the ZmC5 promoter from maize (International PCT Publication No. WO1999/042587.

Additional examples of plant tissue-specific/tissue preferred promoters include, but are not limited to, the root hair-specific cis-elements (RHEs) (Kim et al. *The Plant Cell* 18:2958-2970 (2006)), the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology*, 37(8):1108-1115), corn light harvesting complex promoter (Bansal et al. (1992) Proc. Natl. Acad. Sci. USA 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: *Genetic Engineering of Plants* (Hollaender ed., Plenum Press 1983; and Poulsen et al. (1986) Mol. Gen. Genet. 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), petunia chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) Mol. Gen. Genet. 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612).

Useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched at the onset of senescence, such as the SAG promoter from *Arabidopsis* (Gan et al. (1995) *Science* 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron (see, e.g, SEQ ID NO:21 and SEQ ID NO:22).

Non-limiting examples of introns useful with the present invention include introns from the ADHI gene (e.g., Adhl-S introns 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a one or more polynucleotides of the invention (e.g., a polynucleotide encoding a sequence-specific nucleic acid (e.g., DNA) binding domain, a polynucleotide encoding a deaminase protein or domain, a polynucleotide encoding a reverse transcriptase protein or domain, a polynucleotide encoding a 5'-3' exonuclease polypeptide or domain, a guide nucleic acid and/or reverse transcriptase (RT) template), wherein polynucleotide(s) is/are operably associated with one or more control sequences (e.g., a promoter, terminator and the like). Thus, in some embodiments, one or more expression cassettes may be provided, which are designed to express, for example, a nucleic acid construct of the invention (e.g., a polynucleotide encoding a sequence-specific DNA binding domain, a polynucleotide encoding a nuclease polypeptide/domain, a polynucleotide encoding a deaminase protein/domain, a polynucleotide encoding a reverse transcriptase protein/domain, a polynucleotide encoding a 5'-3' exonuclease polypeptide/domain, a polynucleotide encoding a peptide tag, and/or a polynucleotide encoding an affinity polypeptide, and the like, or comprising a guide nucleic acid, an extended guide nucleic acid, and/or RT template, and the like). When an expression cassette of the present invention comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination). When two or more separate promoters are used, the promoters may be the same promoter or they may be different promoters. Thus, a polynucleotide encoding a sequence specific nucleic acid binding domain, a polynucleotide encoding a nuclease protein/domain, a polynucleotide encoding a CRISPR-Cas effector protein/domain, a polynucleotide encoding an deaminase protein/domain, a polynucleotide encoding a reverse transcriptase polypeptide/domain (e.g., RNA-dependent DNA polymerase), and/or a polynucleotide encoding a 5'-3' exonuclease polypeptide/domain, a guide nucleic acid, an extended guide nucleic acid and/or RT template when comprised in a single expression cassette may each be operably linked to a single promoter, or separate promoters in any combination.

An expression cassette comprising a nucleic acid construct of the invention may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native to, for example, a gene encoding a sequence-specific nucleic acid binding protein, a gene encoding a nuclease, a gene encoding a reverse transcriptase, a gene encoding a deaminase, and the like, or may be native to a host cell, or may be native to another source (e.g., foreign or heterologous to, for example, to a promoter, to a gene encoding a sequence-specific nucleic acid binding protein, a gene encoding a nuclease, a gene encoding a reverse transcriptase, a gene encoding a deaminase, and the like, or to the host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid construct (e.g. expression cassette(s)) comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self-transmissible or mobilizable. In some embodiments, a viral vector can include, but is not limited to, a retroviral, lentiviral, adenoviral, adeno-associated, or herpes simplex viral vector. A vector as defined herein can transform a prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. Accordingly, a nucleic acid or polynucleotide of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). As an example, a target nucleic acid may be contacted with a sequence-specific nucleic acid (e.g., DNA) binding protein (e.g., polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein)) and a deaminase or a nucleic acid construct encoding the same, under conditions whereby the sequence-specific nucleic acid binding protein, the reverse transcriptase and/or the deaminase are expressed and the sequence-specific nucleic acid binding protein binds to the target nucleic acid, and the reverse transcriptase and/or deaminase may be fused to either the sequence-specific nucleic acid binding protein or recruited to the sequence-specific nucleic acid binding protein (via, for example, a peptide tag fused to the sequence-specific nucleic acid binding protein and an affinity tag fused to the reverse transcriptase and/or deaminase) and thus, the deaminase and/or reverse transcriptase is positioned in the vicinity of the target nucleic acid, thereby modifying the target nucleic acid. Other methods for recruiting reverse transcriptase and/or deaminase may be used that take advantage of other protein-protein interactions, and also RNA-protein interactions and chemical interactions may be used for protein-protein and protein-nucleic acid recruitment.

As used herein, "modifying" or "modification" in reference to a target nucleic acid includes editing (e.g., mutating), covalent modification, exchanging/substituting nucleic acids/nucleotide bases, deleting, cleaving, nicking, and/or altering transcriptional control of a target nucleic acid. In some embodiments, a modification may include one or more single base changes (SNPs) of any type.

"Introducing," "introduce," "introduced" (and grammatical variations thereof) in the context of a polynucleotide of interest means presenting a nucleotide sequence of interest (e.g., polynucleotide, RT template, a nucleic acid construct, and/or a guide nucleic acid) to a plant, plant part thereof, or cell thereof, in such a manner that the nucleotide sequence gains access to the interior of a cell.

The terms "transformation" or transfection" may be used interchangeably and as used herein refer to the introduction of a heterologous nucleic acid into a cell. Transformation of a cell may be stable or transient. Thus, in some embodiments, a host cell or host organism (e.g., a plant) may be stably transformed with a polynucleotide/nucleic acid molecule of the invention. In some embodiments, a host cell or host organism may be transiently transformed with a polynucleotide/nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention (e.g., one or more expression cassettes comprising polynucleotides for editing as described herein) may be transiently introduced into a cell with a guide nucleic acid and as such, no DNA is maintained in the cell.

A nucleic acid construct of the invention may be introduced into a plant cell by any method known to those of skill in the art. Non-limiting examples of transformation methods include transformation via bacterial-mediated nucleic acid delivery (e.g., via Agrobacteria), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. Procedures for transforming both eukaryotic and prokaryotic organisms are well known and routine in the art and are described throughout the literature (See, for example, Jiang et al. 2013. *Nat.*

Biotechnol. 31:233-239; Ran et al. *Nature Protocols* 8:2281-2308 (2013)). General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol. Lett.* 7:849-858 (2002)).

In some embodiments of the invention, transformation of a cell may comprise nuclear transformation. In other embodiments, transformation of a cell may comprise plastid transformation (e.g., chloroplast transformation). In still further embodiments, nucleic acids of the invention may be introduced into a cell via conventional breeding techniques. In some embodiments, one or more of the polynucleotides, expression cassettes and/or vectors may be introduced into a plant cell via *Agrobacterium* transformation.

A polynucleotide therefore can be introduced into a plant, plant part, plant cell in any number of ways that are well known in the art. The methods of the invention do not depend on a particular method for introducing one or more nucleotide sequences into a plant, only that they gain access to the interior the cell. Where more than polynucleotide is to be introduced, they can be assembled as part of a single nucleic acid construct, or as separate nucleic acid constructs, and can be located on the same or different nucleic acid constructs. Accordingly, the polynucleotide can be introduced into the cell of interest in a single transformation event, or in separate transformation events, or, alternatively, a polynucleotide can be incorporated into a plant as part of a breeding protocol.

As described herein, editing technology is used to target STAYGREEN (SGR) genes in plants to generate plants having increased resistance to soybean rust. In some aspects, a mutation generated by the editing technology can be a semi-dominant mutation. In some embodiments, mutations may be in an untranslated region of the SGR gene (e.g., in a promoter or promoter region) or by substituting amino acid residues in the SGR polypeptide. The types of mutations useful for production of plants exhibiting increased resistance to soybean rust include, for example, substitutions, deletions and insertions.

In some embodiments, the invention provides a plant or plant part thereof, the plant or plant part comprising at least one non-natural mutation (e.g., 1, 2, 3, 4, 5, or more mutations) in an endogenous SGR gene that encodes a SGR protein. In some embodiments, the mutation may be in the coding region (e.g., cDNA or mRNA) or may be in the untranslated/non-coding region (e.g., in the promoter region) of the SGR gene. In some embodiments, the at least one non-natural mutation may be a point mutation (e.g., a deletion, substitution addition). In some embodiments, the at least one non-natural mutation may be a semi-dominant mutation (e.g., a mutation as described herein that is heterozygous in a plant may be a semi-dominant mutation). In some embodiments, the at least one non-natural mutation may be a deletion, optionally a deletion in an untranslated region of the SGR gene. In some embodiments, the at least one non-natural mutation may be a point mutation that results in a substitution of an amino acid residue in the SGR protein. In some embodiments, the at least one mutation results in a substitution of the amino acid residue located at position 108 with reference to the amino acid position numbering of SEQ ID NO:72 or located at position 110 with reference to the amino acid position numbering of SEQ ID NO:73 or SEQ ID NO:74. In some embodiments, the at least one mutation is Q108R with reference to the amino acid position numbering of SEQ ID NO:72, or Q110R with reference to the amino acid position numbering of SEQ ID NO:73 or SEQ ID NO:74.

In some embodiments, a plant cell is provided, the plant cell comprising an editing system comprising: (a) a CRISPR-Cas effector protein; and (b) a guide nucleic acid (gRNA, gDNA, crRNA, crDNA, sgRNA, sgDNA) comprising a spacer sequence with complementarity to an endogenous target gene encoding a SGR protein. In some embodiments, the editing system generates a mutation in the endogenous target gene encoding a SGR protein. In some embodiments, the mutation is a non-natural mutation. In some embodiments, a guide nucleic acid of an editing system may comprise the nucleotide sequence (e.g., spacer sequence) of any one of SEQ ID NOs:90-112 or 113-114, wherein the spacers comprising SEQ ID NOs:90-112 may be used to target the untranslated region (e.g., promoter region) of the SGR and the spacers comprising SEQ ID NOs:113-114 may be used for making base edits.

The mutation in the SGR gene of a plant or part thereof or a plant cell may be any type of mutation, including a base substitution, a deletion and/or an insertion. In some embodiments, the at least one non-natural mutation may be a point mutation. In some embodiments, a non-natural mutation may comprise a base substitution to an A, a T, a G, or a C. In some embodiments, a non-natural mutation may be a deletion of at least one base pair or an insertion of at least one base pair. In some embodiments, a non-natural mutation may be result in substitution of an amino acid residue in an SRG protein. In some embodiments, the substitution of an amino acid residue in an SRG protein may be a substitution of the amino acid residue located at position 108 with reference to the amino acid position numbering of SEQ ID NO:72 or located at position 110 with reference to the amino acid position numbering of SEQ ID NO:73 or SEQ ID NO:74. In some embodiments, the at least one mutation is Q108R with reference to the amino acid position numbering of SEQ ID NO:72, or Q110R with reference to the amino acid position numbering of SEQ ID NO:73 or SEQ ID NO:74.

In some embodiments, a deletion useful with this invention may be a deletion in the untranslated region or promoter region of a SGR locus. In some embodiments, a deletion may comprise at least 1 base pair to about 2000 consecutive base pairs (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121 122, 123, 124, 125, 130, 135, 140, 145, 150, 155, 160, 161, 162, 163, 164, 165, 170, 175, 200, 205, 210, 215, 220, 225, 230, 235, 240, 241, 242, 243, 244, 245, 250, 300, 350, 400, 450, 500, 550, 600, 650, 700, 750, 800, 850, 900, 950, 1000, 1100, 1200, 1300, 1400, 1500, 1600, 1700, 1800, 1900, or 2000 or more consecutive base pairs or more, or any range or value therein). In some embodiments, a deletion may be at least 1 base pair to about 5 consecutive base pairs, at least 1 base pair to about 10 consecutive base pairs, about 10 consecutive base pairs to about 15 consecutive base pairs, about 10 consecutive base pairs to about 30 consecutive base pairs, about 10 consecutive base pair to about 50 consecutive base pairs, about 50 consecutive base pairs to about 100 consecutive base pairs, about 50 consecutive base pairs to about 200 consecutive base pairs, about 50 consecutive base pairs to about 400 consecutive base pairs, about 50 consecutive base pairs to about 500 consecutive base pairs, about 50 consecutive base pairs to about 750 consecutive base pairs, about 50 consecutive base pairs to about 1000 consecutive base pairs, about 100 consecutive base pairs to about 200 consecutive base pairs, about 100 consecutive base pairs to about 400 consecutive base pairs, about 100 consecutive base pairs to about 500 consecutive base pairs, about 100 consecutive base pairs to about 700 consecutive base pairs, about 100 consecutive base pairs to about 1000 consecutive base pairs, about 500 consecutive base pairs to about 1000 consecutive base pairs, about 500 consecutive base pairs to about 1200 consecutive base pairs, about 500 consecutive base pairs to about 1500 consecutive base pairs, about 1000 consecutive base pairs to about 1200 consecutive base pairs, about 1000 consecutive base pairs to about 1500 consecutive base pairs, about 1000 consecutive base pairs to about 1800 consecutive base pairs or about 1500 consecutive base pairs to about 2000 consecutive base pairs. In some embodiments, a deletion may comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 consecutive base pairs to about 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121 122, 123, 124, 125, 130, 135, 140, 145, 150, 155, 160, 161, 162, 163, 164, 165, 170, 175, 200, 205, 210, 215, 220, 225, 230, 235, 240, 241, 242, 243, 244, 245, 250, 300, 350, 400, 450, 500, 550, 600, 650, 700, 750, 800, 850, 900, 950, 1000, 1100, 1200, 1300, 1400, 1500, 1600, 1700, 1800, 1000, or 2000 consecutive base pairs or more, or any range or value therein.

An endogenous SGR gene useful with this invention may include, for example, a SGR1 or SGR2 (e.g., SGR1, SGR2 from soybean). In some embodiments, an endogenous SGR gene may comprise a region having at least 90% sequence identity (e.g., about 90, 91, 92, 93, 94, 95, 96, 97, 98, 99, 99.5, 100% sequence identity) to any one of the nucleotide sequences of SEQ ID NO:75, SEQ ID NO:76, SEQ ID NO:77, SEQ ID NO:78, SEQ ID NO:79, or SEQ ID NO:80. In some embodiments, a SGR protein may comprise a sequence having at least 95% sequence identity (e.g., about 95, 96, 97, 98, 99, 99.5, 99.6, 99.7, 99.8, 99.9, 100% sequence identity) to any one of the amino acid sequences of SEQ ID NO:72, SEQ ID NO:73, or SEQ ID NO:74 or may comprise a region having at least 95% sequence identity (e.g., about 95, 96, 97, 98, 99, 99.5, 99.6, 99.7, 99.8, 99.9, 100% sequence identity) to any one of the amino acid sequences of SEQ ID NOs:83-89. In some embodiments, an SGR protein may be encoded by a sequence having at least 90% identity to the nucleotide sequence of SEQ ID NO:81 or SEQ ID NO:82. In some embodiments, an SGR protein may be encoded by a sequence having at least 90% identity to any one of the nucleotide sequences of SEQ ID NO:77-80.

In some embodiments, the plant comprising at least one mutation in an endogenous SGR gene exhibits increased resistance to soybean rust as compared to a plant without the at least one non-natural mutation (e.g., an isogenic wild type plant without the mutation). In some embodiments, the plant may be a soybean plant. In some embodiments, the plant part and/or plant cell may be from a soybean plant or part thereof.

In some embodiments, a plant may be regenerated from the plant part and/or the plant cell of the invention, wherein the plant comprises the mutation in the endogenous SGR gene and exhibits increased resistance to soybean rust, optionally wherein the plant is a soybean (as compared to a plant not comprising the mutation; e.g., as compared to a an isogenic wild type plant not comprising the mutation).

In some embodiments, a soybean plant cell is provided, the soybean plant cell comprising at least one non-natural mutation within an endogenous SGR gene, wherein the mutation is a substitution, insertion or a deletion that is introduced using an editing system that comprises a nucleic acid binding domain that binds to a target site in the SGR gene. In some embodiments, the SGR gene (a) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (b) encodes a polypeptide (i) comprising a sequence having at least 95% sequence identity to any one of the amino acid sequences of SEQ ID NO:73 or SEQ ID NO:74, (ii) comprising a region having at least 90% sequence identity to a nucleotide sequence encoding any one of the amino acid sequences of SEQ ID NOs:83-89 and/or (ii) encoded by a sequence having at least 90% sequence identity to the nucleotide sequence of SEQ ID NO:81 or SEQ ID NO:82. In some embodiments, the target site is within the untranslated region or the promoter region of the SGR gene (e.g., the untranslated regions of any one of the polypeptide sequences of SEQ ID NOs:75-78). In some embodiments, the target site is in the coding region of the SGR gene. In some embodiments, the target site is within a region of the SGR gene, said region comprising the 3' region of a sequence having at least 90% sequence identity to any one of the nucleotide sequences of SEQ ID NO:75 or SEQ ID NO:76 (e.g., nucleotide 1000 to nucleotide 2229 of SEQ ID NO:75 or nucleotide 1000 to nucleotide 2216 of SEQ ID NO:76) or the 5' region of a sequence having at least 90% sequence identity to any one of the nucleotide sequences of SEQ ID NO:77 or SEQ ID NO:78 (e.g., nucleotide 1 to nucleotide 300 or 400 of SEQ ID NO:77 or nucleotide 1 to nucleotide 220 or 320 of SEQ ID NO:78). In some embodiments, the at least one non-naturally occurring mutation of an SGR gene is a point mutation. In some embodiments, the at least one non-naturally occurring mutation within an SGR gene is a semi-dominant mutation. In some embodiments, a non-natural mutation may be result in substitution of an amino acid residue in an SRG protein. In some embodiments, the substitution of an amino acid residue in an SRG protein may be a substitution of the amino acid residue located at position 108 with reference to the amino acid position numbering of SEQ ID NO:72 or located at position 110 with reference to the amino acid position numbering of SEQ ID NO:73 or SEQ ID NO:74. In some embodiments, the at least one mutation is Q108R with reference to the amino acid position numbering of SEQ ID NO:72, or Q110R with reference to the amino acid position numbering of SEQ ID NO:73 or SEQ ID NO:74.

In some embodiments, a method of producing/breeding a transgene-free edited soybean plant is provided, the method comprising: crossing a soybean plant of the present invention (e.g., a soybean plant comprising a mutation in a SGR gene and having increased resistance to soybean rust (e.g., Asian soybean rust, New World soybean rust)) with a transgene free soybean plant, thereby introducing the at least one non-natural mutation into the soybean plant that is transgene-free; and selecting a progeny soybean plant that comprises the at least one non-natural mutation and is transgene-free, thereby producing a transgene free edited soybean plant.

Also provided herein is a method of providing a plurality of soybean plants having increased resistance to soybean rust, the method comprising planting two or more soybean plants of the invention (e.g., 2, 3, 4, 5, 6, 7, 8, 9, 10 or more soybean plants comprising a mutation in a SGR polypeptide and having increases soybean rust resistance) in a growing area (e.g., a field (e.g., a cultivated field, an agricultural field), a growth chamber, a greenhouse, a recreational area, a lawn, and/or a roadside and the like), thereby providing a plurality of soybean plants having increased soybean rust resistance as compared to a plurality of control soybean plants not comprising the mutation (e.g., as compared to an isogenic wild type plant not comprising the mutation).

In some embodiments, a method for editing a specific site in the genome of a soybean plant cell is provided, the method comprising: cleaving, in a site-specific manner, a target site within an endogenous SGR gene in the soybean plant cell, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby generating an edit in an endogenous SGR gene of the soybean plant cell and producing a plant cell comprising the edit in an endogenous SGR gene. In some embodiments, the edit results in a non-naturally occurring mutation, including but not limited, to a deletion, substitution, or insertion. In some embodiments, the edit is a point mutation. In some embodiments, the edit produces a semi-dominant mutation. In some embodiments, the non-naturally occurring mutation is a deletion, optionally wherein the deletion comprises at least 1 base pair to about 2000 consecutive base pairs of the SGR gene as described herein. In some embodiments, the deletion is in the 3' region of the untranslated region of a SGR gene, for example, in the 3' region of SEQ ID NOs: 75-76 (e.g., from about nucleotide 1000 to the end of the sequence; e.g., nucleotide 1000 to nucleotide 2229 of SEQ ID NO:75 or nucleotide 1000 to nucleotide 2216 of SEQ ID NO:76) or the various untranslated regions of SEQ ID NOs:77-80.

In some embodiments, a method of editing may further comprise regenerating a soybean plant from the soybean plant cell comprising the edit in the endogenous SGR gene, thereby producing a soybean plant comprising the edit in its endogenous SGR gene and having increased resistance to soybean rust compared to a control soybean plant (e.g., an isogenic wild-type soybean plant) that does not comprise the edit.

In some embodiments, a method for making a soybean plant is provided, the method, comprising: (a) contacting a population of soybean plant cells comprising at least one wild type endogenous SGR gene with a nuclease linked to a nucleic acid binding domain (e.g., a DNA binding domain; e.g., an editing system) that binds to a target site in the at least one wild type endogenous SGR gene, the wild type endogenous SGR gene (i) comprising a sequence having at least 90% sequence identity to the nucleotide sequence of SEQ ID NO:79-82; (ii) comprising a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (iii) encoding a polypeptide sequence (1) having at least 95% sequence identity to the amino acid sequence of SEQ ID NO:73 or SEQ ID NO:74; and/or (2) comprising a region having at least 90% sequence identity to any one of the amino acid sequences of SEQ ID NOs:83-89; (b) selecting a plant cell from said population in which at least one wild type endogenous SGR gene has been mutated; and (c) growing the selected soybean plant cell into a soybean plant having a mutation in an endogenous SGR gene.

In some embodiments, a method for increasing soybean rust resistance in a soybean plant or part thereof is provided, the method comprising (a) contacting a soybean plant cell comprising a wild type endogenous SGR gene with a nuclease targeting the wild type endogenous SGR gene, wherein the nuclease is linked to a nucleic acid binding domain that binds to a target site in the wild type endogenous SGR gene, wherein the wild type endogenous SGR gene: (i) comprises a sequence having at least 90% sequence identity to the nucleotide sequence of SEQ ID NO:79-82; (ii) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (iii) encodes a polypeptide sequence (1) having at least 95% sequence identity to the amino acid sequence of SEQ ID NO:73 or SEQ ID NO:74; and/or (2) comprising a region having at least 90% sequence identity to any one of the amino acid sequences of SEQ ID NOs:83-89, thereby producing a plant cell comprising a mutation in the wild type endogenous SGR gene; and (b) growing the plant cell into a plant comprising the mutation in the wild type endogenous SGR gene, thereby increasing soybean rust resistance in a soybean plant or part thereof.

In some embodiments, a method for producing a soybean plant or part thereof comprising at least one cell having a mutated endogenous SGR gene, the method comprising contacting a target site in an endogenous SGR gene in the soybean plant or plant part with a nuclease comprising a cleavage domain and a nucleic acid binding domain, wherein the nucleic acid binding domain binds to a target site in the endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby producing a plant cell comprising a mutation in the wild type endogenous SGR gene, thereby producing the soybean plant or part thereof comprising at least one cell having a mutation in the endogenous SGR gene.

Also provided herein is a method for producing a soybean plant or part thereof comprising a mutation in an endogenous SGR polypeptide and exhibiting increased resistance to soybean rust, the method comprising contacting a target site in an endogenous SGR gene in the soybean plant or plant part with a nuclease comprising a cleavage domain and a nucleic acid binding domain, wherein the nucleic acid binding domain binds to a target site in the endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby producing the soybean plant or part thereof comprising an endogenous SGR gene having a mutation and exhibiting increased resistance to soybean rust.

In some embodiments, a nuclease may cleave an endogenous SGR gene, thereby introducing the mutation into the endogenous SGR gene. A nuclease useful with the invention may be any nuclease that can be utilized to edit/modify a target nucleic acid. Such nucleases include, but are not limited to a zinc finger nuclease, transcription activator-like effector nucleases (TALEN), endonuclease (e.g., Fok1) and/or a CRISPR-Cas effector protein. Likewise, any nucleic acid binding domain useful with the invention may be any nucleic acid binding domain that can be utilized to edit/modify a target nucleic acid. In some embodiments, a nucleic acid binding domain is a DNA binding domain, including, but not limited to, a zinc finger, transcription activator-like DNA binding domain (TAL), an argonaute and/or a CRISPR-Cas effector DNA binding domain.

In some embodiments, a method of editing an endogenous SGR gene in a plant or plant part is provided, the method comprising contacting a target site in SGR gene in the plant or plant part with a cytosine base editing system comprising a cytosine deaminase and a nucleic acid binding domain that binds to a target site in the SGR gene, the SGR gene: (a) comprising a sequence having at least 90% sequence identity to the nucleotide sequence of SEQ ID NOs:81-82, (b) comprising region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encoding a polypeptide (i) having at least 95% sequence identity to the amino acid sequence of SEQ ID NO:73 or SEQ ID NO:74; and/or (ii) comprises a region having at least 90% sequence identity to a nucleotide sequence encoding any one of the amino acid sequences of SEQ ID NOs:83-89, thereby producing the soybean plant or part thereof comprising an endogenous SGR gene having a mutation and exhibiting increased resistance to soybean rust.

In some embodiments, a method of editing an endogenous SGR gene in a plant or plant part is provided, the method comprising contacting a target site in SGR gene in the plant or plant part with an adenosine base editing system comprising an adenosine deaminase and a nucleic acid binding domain that binds to a target site in the SGR gene, the SGR gene: (a) comprising a sequence having at least 90% sequence identity to the nucleotide sequence of SEQ ID NOs:81-82, (b) comprising region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encoding a polypeptide (i) having at least 95% sequence identity to the amino acid sequence of SEQ ID NO:73 or SEQ ID NO:74; and/or (ii) comprises a region having at least 60 90% sequence identity to a nucleotide sequence encoding any one of the amino acid sequences of SEQ ID NOs:83-89, thereby producing the soybean plant or part thereof comprising an endogenous SGR gene having a mutation and exhibiting increased resistance to soybean rust.

In some embodiments, a method of detecting a mutant SGR gene (a mutation in an endogenous SGR gene) is provide, the method comprising detecting in the genome of a plant a mutation in a nucleic acid encoding the amino acid sequence of, for example, any one of SEQ ID NOs: 72-74 or SEQ ID NOs:83-89 that results in a substitution in an amino acid residue of the amino acid sequence.

In some embodiments, a method of detecting a mutant SGR gene (a mutation in an endogenous SGR gene) is provide, the method comprising detecting in the genome of a plant a deletion in the nucleotide sequence of, for example, SEQ ID NOs:75 or SEQ ID NO:76.

In some embodiments, the present invention provides a method of detecting a mutation in an endogenous SGR gene, comprising detecting in the genome of a plant a mutated SGR gene produced as described herein.

In some embodiments, the present invention provides a method of producing a plant comprising a mutation in an endogenous SGR gene and at least one polynucleotide of interest, the method comprising crossing a plant of the invention comprising at least one mutation in an endogenous SGR gene (a first plant) with a second plant that comprises the at least one polynucleotide of interest to produce progeny plants; and selecting progeny plants comprising at least one mutation in the SGR gene and the at least one polynucleotide of interest, thereby producing the plant comprising a mutation in an endogenous SGR gene and at least one polynucleotide of interest.

The present invention further provides a method of producing a plant comprising a mutation in an endogenous SGR gene and at least one polynucleotide of interest, the method comprising introducing at least one polynucleotide of interest into a plant of the present invention comprising at least one mutation in a SGR gene, thereby producing a plant comprising at least one mutation in a SGR gene and at least one polynucleotide of interest.

In some embodiments, the present invention provides a method of producing a plant comprising a mutation in an endogenous SGR gene and at least one polynucleotide of interest, the method comprising introducing at least one polynucleotide of interest into a plant of the invention comprising at least one mutation in an endogenous SGR gene, thereby producing a plant comprising at least one mutation in a SGR gene and at least one polynucleotide of interest.

A polynucleotide of interest may be any polynucleotide that can confer a desirable phenotype or otherwise modify the phenotype or genotype of a plant. In some embodiments, a polynucleotide of interest may be polynucleotide that confers herbicide tolerance, insect resistance, disease resistance, increased yield, increased nutrient use efficiency or abiotic stress resistance.

A STAYGREEN (SGR) gene useful with this invention includes any SGR gene in which a mutation as described herein can confer increased soybean rust resistance in a plant or part thereof comprising the mutation. In some embodiments, the SGR gene is SGR1 or SGR2. In some embodiments, the SGR gene encodes a polypeptide that: (a) comprises an amino acid sequence having at least 95% sequence identity (e.g., 95%, 96%, 97%, 98%, 99%, 99.1%, 99.2%, 99.3%, 99.4%, 99.5%, 99.6%, 99.7%, 99.8%, 99.9% or 100% identity) to the amino acid sequence of any one of SEQ ID NO:73 or SEQ ID NO:74; (b) comprises a region having at least 95% sequence identity to any one of the amino acid sequences of SEQ ID NOs:83-89; and/or (c) is encoded by a sequence having at least 90% sequence identity (e.g., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100% identity) to the nucleotide sequence of SEQ ID NO:79, SEQ ID NO:80, SEQ ID NO:81 or SEQ ID NO:82. In some embodiments, an SGR gene may comprise a sequence having at least about 90% sequence identity (e.g., 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100% identity) to any one of the nucleotide sequences of SEQ ID NO:75, SEQ ID NO:76, SEQ ID NO:77, SEQ ID NO:78, SEQ ID NO:79, or SEQ ID NO:80.

In some embodiments, the at least one non-natural mutation in an endogenous SGR gene is a point mutation. In some embodiments, the at least one non-natural mutation in an endogenous SGR gene is a semi-dominant mutation. In some embodiments, the at least one non-natural mutation in an endogenous SGR gene in a plant may be a base substitution, a base deletion and/or a base insertion. In some embodiments, the at least one non-natural mutation in an endogenous SGR gene in a plant may be a base substitution, a base deletion and/or a base insertion that results in a point mutation and a plant having increased resistance to soybean rust. In some embodiments, the at least one non-natural mutation in an endogenous SGR gene in a plant may be a base substitution, a base deletion and/or a base insertion that results in a semi-dominant mutation and a plant having increased resistance to soybean rust. In some embodiments, the at least one non-natural mutation may comprise an insertion, deletion, or substitution of about 1, 2, 3, 4, or 5 or more nucleotides, which may result in a substitution, a deletion and/or an insertion of one or more amino acid residue. In some embodiments, the at least one non-natural mutation may be a base substitution to an A, a T, a G, or a C.

In some embodiments, a non-natural mutation may be an edit that results in substitution of an amino acid residue in an SRG protein. In some embodiments, the substitution of an amino acid residue in an SRG protein may be a substitution of the amino acid residue located at position 108 with reference to the amino acid position numbering of SEQ ID NO:72 or located at position 110 with reference to the amino acid position numbering of SEQ ID NO:73 or SEQ ID NO:74. In some embodiments, the at least one mutation is Q108R with reference to the amino acid position numbering of SEQ ID NO:72, or Q110R with reference to the amino acid position numbering of SEQ ID NO:73 or SEQ ID NO:74.

In some embodiments, a deletion useful for this invention may be a deletion of at least 2 consecutive nucleotides (e.g., about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides, or any range or value therein) from the gene encoding the SGR polynucleotide. In some embodiments, the deletion is in an untranslated region of the SGR gene (e.g., a region of SEQ ID NOs:75-76).

In some embodiments, a deletion comprises a loss of about 1 base pair to about 2000 consecutive base pairs or from the untranslated region of an endogenous gene encoding an SGR gene (e.g., SEQ ID NOs:75-76).

A non-natural mutation in an endogenous gene encoding an SGR polypeptide that provides plants with increased resistance to soybean rust may be a dominant recessive mutation.

In some embodiments, a mutation in an endogenous SGR gene may be made following cleavage by an editing system that comprises a nuclease and a nucleic acid binding domain that binds to a target site in an endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, thereby producing the soybean plant or part thereof comprising an endogenous SGR gene having a mutation and exhibiting increased resistance to soybean rust.

Further provided herein are guide nucleic acids (e.g., gRNA, gDNA, crRNA, crDNA) that bind to a target site in an endogenous SGR gene, the endogenous SGR gene: (a) comprising a sequence having at least 90% sequence identity to the nucleotide sequence of SEQ ID NO:81 or SEQ ID NO:82; (b) having at least 90% sequence identity to any one of the nucleotide sequences of SEQ ID NOs:75-80; and/or (c) encoding a polypeptide sequence: (i) having at least 95% sequence identity to the amino acid sequence of SEQ ID NO:73 or SEQ ID NO:74; (ii) comprising a region having at least 90% sequence identity to any one of the amino acid sequences of SEQ ID NOs:83-89. In some embodiments, the target site in the endogenous SGR gene is in an untranslated region, preferably in the 3' region of the untranslated region. In some embodiments, the target site in the endogenous SGR gene is in promoter or promoter region. In some embodiments, the target in the endogenous SGR gene is in a coding region (see e.g., SEQ ID NO:79-82).

Additionally provided is a system comprising a guide nucleic acid of the invention and a CRISPR-Cas effector protein that associates with the guide nucleic acid, optionally wherein the guide nucleic acid comprises a spacer sequence having the nucleotide sequence of SEQ ID NOs: 90-114. In some embodiments, the system further comprises comprising a tracr nucleic acid that associates with the guide nucleic acid and a CRISPR-Cas effector protein, optionally wherein the tracr nucleic acid and the guide nucleic acid are covalently linked. As used herein, "a tracr nucleic acid that associates with a guide nucleic acid and a CRISPR-Cas effector protein" refers to the complex that is formed between a tracr nucleic acid, a guide nucleic acid and a CRISPR-Cas effector protein in order to direct the CRISPR-Cas effector protein to a target site in a gene.

The invention further provides a gene editing system comprising a CRISPR-Cas effector protein in association with a guide nucleic acid and the guide nucleic acid comprises a spacer sequence that binds to an endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89. In some embodiments, the guide nucleic acid comprises a spacer sequence having the nucleotide sequence of any one of SEQ ID NOs:90-114. In some embodiments, the gene editing system may further comprise a tracr nucleic acid that associates with the guide nucleic acid and a CRISPR-Cas effector protein, optionally wherein the tracr nucleic acid and the guide nucleic acid are covalently linked. As used herein, "a CRISPR-Cas effector protein in association with a guide nucleic acid" refers to the complex that is formed between a CRISPR-Cas effector protein and a guide nucleic acid in order to direct the CRISPR-Cas effector protein to a target site in a gene.

The present invention further provides a guide nucleic acid and a complex comprising a CRISPR-Cas effector protein comprising a cleavage domain, wherein the guide nucleic acid binds to a target site in an endogenous SGR gene, wherein the endogenous SGR gene (a) comprises a sequence having at least 90% sequence identity to the nucleotide sequence of SEQ ID NO:81 or SEQ ID NO:82; (b) comprises a region having at least 90% sequence identity to any one of the nucleotide sequences of SEQ ID NO:75, SEQ ID NO:76, SEQ ID NO:77, SEQ ID NO:78, SEQ ID NO:79, or SEQ ID NO:80, and/or (c) encodes a polypeptide sequence (i) having at least 95% sequence identity to the amino acid sequence of SEQ ID NO:73 or SEQ ID NO:74; and/or (ii) comprising a region having at least 90% sequence identity to any one of the amino acid sequences of SEQ ID NOs:83-89, wherein the cleavage domain cleaves a target strand in the SGR gene.

In some embodiments, expression cassettes are provided that comprise a polynucleotide encoding CRISPR-Cas effector protein comprising a cleavage domain and a guide nucleic acid that binds to a target site in an endogenous SGR gene, wherein the guide nucleic acid comprises a spacer sequence that is complementary to and binds a portion of a sequence (a) having at least 90% sequence identity to the nucleotide sequences of SEQ ID NOs:75-80, (b) encoding a sequence having at least 95% sequence identity to any one of the amino acid sequences of SEQ ID NOs:72-74 or 83-89; and/or (c) encoded by a by a sequence having at least 90% sequence identity to the nucleotide sequence of SEQ ID NO:81 or SEQ ID NO:82.

Also provided herein are nucleic acids encoding a semi-dominant mutation in a SGR gene, wherein the semi-dominant mutation when present in a plant or plant part (e.g., a soybean plant) results in the plant exhibiting increased resistance to soybean rust as compared to a plant or plant part not comprising the semi-dominant mutation.

Nucleic acid constructs of the invention (e.g., a construct comprising a sequence specific DNA binding domain, a CRISPR-Cas effector domain, a deaminase domain, reverse transcriptase (RT), RT template and/or a guide nucleic acid, etc.) and expression cassettes/vectors comprising the same may be used as an editing system of this invention for modifying target nucleic acids (e.g., endogenous SGR genes) and/or their expression.

Any plant comprising an endogenous SGR gene that is capable of conferring resistance to soybean rust when modified as described herein (e.g., mutated, e.g., base edited, cleaved, nicked, etc.) (e.g., using the polypeptides, polynucleotides, RNPs, nucleic acid constructs, expression cassettes, and/or vectors of the invention) may be used with this invention to increase resistance to soybean rust in the plant.

A plant having increased resistance (e.g., a soybean plant) to soybean rust may have an increase in resistance of about 5% to about 100% (e.g., about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100% or any range or value therein) as compared to a plant or part thereof that does not comprise the mutated endogenous SGR gene (for an example, an isogenic wild type plant not comprising the mutation). A plant having increased resistance to soybean rust may also be described as exhibiting reduced susceptibility to soybean rust (e.g., reduced susceptibility to *P. pachyrhizi* and *P. meibomiae*) of about 5% to about 100% as compared to a as compared to a plant or part thereof that does not comprise the mutated endogenous SGR gene. In some embodiments, resistance and susceptibility may be measured by the amount (incidence) or severity of chlorosis or necrotic regions (e.g., lesions) (the number and size) or the amount of defoliation or by the number of pustules formed and their size.

As an example, the level of disease is measured using a leaf senescence assay. For such an assay, leaf punches are taken from fully expanded V3 trifoliate leaves. The leaf punches are floated on ½ MS liquid media in, for example, 12-well plates and the plates are wrapped in foil and incubated at room temperature for about 7 days. Following the incubation, the leaf punches are imaged and RGB pixel quantification is performed. Average pixel proportions per punch are compared between edited and control lines to determine if chlorophyll degradation in the dark (aka leaf senescence) has been slowed. Chlorophyll degradation is absent in plants in which the SGR gene is knocked-out. The methods of the invention produce plants have levels of chlorophyll degradation as measured by this assay that are intermediate between a plant comprising a wild-type SGR gene and a plant comprising a null or absent SGR (e.g., an SGR knockout), thereby producing a plant that has increase resistance to soybean rust.

The term "plant part," as used herein, includes but is not limited to reproductive tissues (e.g., petals, sepals, stamens, pistils, receptacles, anthers, pollen, flowers, fruits, flower bud, ovules, seeds, and embryos); vegetative tissues (e.g., petioles, stems, roots, root hairs, root tips, pith, coleoptiles, stalks, shoots, branches, bark, apical meristem, axillary bud, cotyledon, hypocotyls, and leaves); vascular tissues (e.g., phloem and xylem); specialized cells such as epidermal cells, parenchyma cells, chollenchyma cells, schlerenchyma cells, stomates, guard cells, cuticle, mesophyll cells; callus tissue; and cuttings. The term "plant part" also includes plant cells, including plant cells that are intact in plants and/or parts of plants, plant protoplasts, plant tissues, plant organs, plant cell tissue cultures, plant calli, plant clumps, and the like. As used herein, "shoot" refers to the above ground parts including the leaves and stems. As used herein, the term "tissue culture" encompasses cultures of tissue, cells, protoplasts and callus.

As used herein, "plant cell" refers to a structural and physiological unit of the plant, which typically comprise a cell wall but also includes protoplasts. A plant cell of the present invention can be in the form of an isolated single cell or can be a cultured cell or can be a part of a higher-organized unit such as, for example, a plant tissue (including callus) or a plant organ. A "protoplast" is an isolated plant cell without a cell wall or with only parts of the cell wall. Thus, in some embodiments of the invention, a transgenic cell comprising a nucleic acid molecule and/or nucleotide sequence of the invention is a cell of any plant or plant part including, but not limited to, a root cell, a leaf cell, a tissue culture cell, a seed cell, a flower cell, a fruit cell, a pollen cell, and the like. In some aspects of the invention, the plant part can be a plant germplasm. In some aspects, a plant cell can be non-propagating plant cell that does not regenerate into a plant.

"Plant cell culture" means cultures of plant units such as, for example, protoplasts, cell culture cells, cells in plant tissues, pollen, pollen tubes, ovules, embryo sacs, zygotes and embryos at various stages of development.

As used herein, a "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

In some embodiments of the invention, a transgenic tissue culture or transgenic plant cell culture is provided, wherein the transgenic tissue or cell culture comprises a nucleic acid molecule/nucleotide sequence of the invention. In some embodiments, transgenes may be eliminated from a plant developed from the transgenic tissue or cell by breeding of the transgenic plant with a non-transgenic plant and selecting among the progeny for the plants comprising the desired gene edit and not the transgenes used in producing the edit.

Any plant may be used with this invention. In some embodiments, a plant useful with the invention may be, for example, a leafy green (e.g., lettuce, kale, collards, arugula, spinach, and the like). In some embodiments, a plant useful with the invention may be a plant in the Brassicaceae family including but not limited to plants such as broccoli, brussels sprouts, cabbage, cauliflower and the like. In some embodiments, the invention may also be useful for producing dark pigmented fruits, including but not limited to, plants in the Solanaceae family (e.g., tomato, pepper, eggplant and the like) and/or plants that produce berries and drupes such as a cherry. In some embodiments, a plant useful with this invention may be a row crop species (e.g., corn, soybean and the like).

Accordingly, non-limiting examples of plants useful with the present invention include, but are not limited to, turf grasses (e.g., bluegrass, bentgrass, ryegrass, fescue), feather reed grass, tufted hair grass, *miscanthus, arundo*, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, *papaya*, and lychee, a field crop plant such as clover, alfalfa, timothy, evening primrose, meadow foam, corn/maize (field, sweet, popcorn), hops, jojoba, buckwheat, safflower, *quinoa*, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), *Cannabis* (e.g., *Cannabis sativa, Cannabis indica*, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, *eucalyptus*, willow), as well as shrubs and other nursery stock. In some embodiments, the nucleic acid constructs of the invention and/or expression cassettes and/or vectors encoding the same may be used to modify maize, soybean, wheat, canola, rice, tomato, pepper, sunflower, raspberry, blackberry, black raspberry and/or cherry. In some embodiments, the nucleic acid constructs of the invention and/or expression cassettes and/or vectors encoding the same may be used to modify a *Rubus* spp. (e.g., blackberry, black raspberry, boysenberry, loganberry, raspberry, e.g., caneberry), a *Vaccinium* spp. (e.g., cranberry), a *Ribes* spp. (e.g., gooseberry, currants (e.g., red currant, black currant)), or a *Fragaria* spp. (e.g., strawberry).

An editing system useful with this invention can be any site-specific (sequence-specific) genome editing system now known or later developed, which system can introduce mutations in target specific manner. For example, an editing system (e.g., site- or sequence-specific editing system) can include, but is not limited to, a CRISPR-Cas editing system, a meganuclease editing system, a zinc finger nuclease (ZFN) editing system, a transcription activator-like effector nuclease (TALEN) editing system, a base editing system and/or a prime editing system, each of which can comprise one or more polypeptides and/or one or more polynucleotides that when expressed as a system in a cell can modify (mutate) a target nucleic acid in a sequence specific manner. In some embodiments, an editing system (e.g., site- or sequence-specific editing system) can comprise one or more polynucleotides and/or one or more polypeptides, including but not limited to a nucleic acid binding domain (DNA binding domain), a nuclease, and/or other polypeptide, and/or a polynucleotide.

In some embodiments, an editing system can comprise one or more sequence-specific nucleic acid binding domains (DNA binding domains) that can be from, for example, a polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein. In some embodiments, an editing system can comprise one or more cleavage domains (e.g., nucleases) including, but not limited to, an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN). In some embodiments, an editing system can comprise one or more polypeptides that include, but are not limited to, a deaminase (e.g., a cytosine deaminase, an adenine deaminase), a reverse transcriptase, a Dna2 polypeptide, and/or a 5' flap endonuclease (FEN). In some embodiments, an editing system can comprise one or more polynucleotides, including, but is not limited to, a CRISPR array (CRISPR guide) nucleic acid, extended guide nucleic acid, and/or a reverse transcriptase template.

In some embodiments, a method of modifying or editing a SGR gene may comprise contacting a target nucleic acid (e.g., a nucleic acid encoding a SGR protein) with a base-editing fusion protein (e.g., a sequence specific nucleic acid binding protein (e.g., a CRISPR-Cas effector protein or domain) fused to a deaminase domain (e.g., an adenine deaminase and/or a cytosine deaminase) and a guide nucleic acid, wherein the guide nucleic acid is capable of guiding/targeting the base editing fusion protein to the target nucleic acid, thereby editing a locus within the target nucleic acid. In some embodiments, a base editing fusion protein and guide nucleic acid may be comprised in one or more expression cassettes. In some embodiments, the target nucleic acid may be contacted with a base editing fusion protein and an expression cassette comprising a guide nucleic acid. In some embodiments, the sequence-specific nucleic acid binding fusion proteins and guides may be provided as ribonucleoproteins (RNPs). In some embodiments, a cell may be contacted with more than one base-editing fusion protein and/or one or more guide nucleic acids that may target one or more target nucleic acids in the cell.

In some embodiments, a method of modifying or editing a SGR gene may comprise contacting a target nucleic acid (e.g., a nucleic acid encoding a SGR protein) with a sequence-specific nucleic acid binding fusion protein (e.g., a sequence-specific nucleic acid binding protein (e.g., a CRISPR-Cas effector protein or domain) fused to a peptide tag, a deaminase fusion protein comprising a deaminase domain (e.g., an adenine deaminase and/or a cytosine deaminase) fused to an affinity polypeptide that is capable of binding to the peptide tag, and a guide nucleic acid, wherein the guide nucleic acid is capable of guiding/targeting the sequence-specific nucleic acid binding fusion protein to the target nucleic acid and the sequence-specific nucleic acid binding fusion protein is capable of recruiting the deaminase fusion protein to the target nucleic acid via the peptide tag-affinity polypeptide interaction, thereby editing a locus within the target nucleic acid. In some embodiments, the sequence-specific nucleic acid binding fusion protein may be fused to the affinity polypeptide that binds the peptide tag and the deaminase may be fuse to the peptide tag, thereby recruiting the deaminase to the sequence-specific nucleic acid binding fusion protein and to the target nucleic acid. In some embodiments, the sequence-specific binding fusion protein, deaminase fusion protein, and guide nucleic acid may be comprised in one or more expression cassettes. In some embodiments, the target nucleic acid may be contacted with a sequence-specific binding fusion protein, deaminase fusion protein, and an expression cassette comprising a guide nucleic acid. In some embodiments, the sequence-specific nucleic acid binding fusion proteins, deaminase fusion proteins and guides may be provided as ribonucleoproteins (RNPs).

In some embodiments, methods such as prime editing may be used to generate a mutation in an endogenous SGR gene. In prime editing, RNA-dependent DNA polymerase (reverse transcriptase, RT) and reverse transcriptase templates (RT template) are used in combination with sequence specific nucleic acid binding domains that confer the ability to recognize and bind the target in a sequence-specific manner, and which can also cause a nick of the PAM-containing strand within the target. The nucleic acid binding domain may be a CRISPR-Cas effector protein and in this case, the CRISPR array or guide RNA may be an extended guide that comprises an extended portion comprising a primer binding site (PSB) and the edit to be incorporated into the genome (the template). Similar to base editing, prime editing can take advantageous of the various methods of recruiting proteins for use in the editing to the target site, such methods including both non-covalent and covalent interactions between the proteins and nucleic acids used in the selected process of genome editing.

As used herein, a "CRISPR-Cas effector protein" is a protein or polypeptide or domain thereof that cleaves or cuts a nucleic acid, binds a nucleic acid (e.g., a target nucleic acid and/or a guide nucleic acid), and/or that identifies, recognizes, or binds a guide nucleic acid as defined herein. In some embodiments, a CRISPR-Cas effector protein may be an enzyme (e.g., a nuclease, endonuclease, nickase, etc.) or portion thereof and/or may function as an enzyme. In some embodiments, a CRISPR-Cas effector protein refers to a CRISPR-Cas nuclease polypeptide or domain thereof that comprises nuclease activity or in which the nuclease activity has been reduced or eliminated, and/or comprises nickase activity or in which the nickase has been reduced or eliminated, and/or comprises single stranded DNA cleavage activity (ss DNAse activity) or in which the ss DNAse activity has been reduced or eliminated, and/or comprises self-processing RNAse activity or in which the self-processing RNAse activity has been reduced or eliminated. A CRISPR-Cas effector protein may bind to a target nucleic acid.

In some embodiments, a sequence-specific nucleic acid binding domain (e.g., sequence-specific DNA binding domain) may be a CRISPR-Cas effector protein. In some embodiments, a CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be Type II CRISPR-Cas effector protein, for example, a Cas9 effector protein. In some embodiments, a CRISPR-Cas effector protein may be Type V CRISPR-Cas effector protein, for example, a Cas12 effector protein.

In some embodiments, a CRISPR-Cas effector protein may include, but is not limited to, a Cas9, C2c1, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5 nuclease, optionally wherein the CRISPR-Cas effector protein may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c effector protein.

In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," e.g., dCas. In some embodiments, a CRISPR-Cas effector protein domain or polypeptide having a mutation in its nuclease active site may have impaired activity or reduced activity as compared to the same CRISPR-Cas effector protein without the mutation, e.g., a nickase, e.g, Cas9 nickase, Cas12a nickase.

A CRISPR Cas9 effector protein or CRISPR Cas9 effector domain useful with this invention may be any known or later identified Cas9 nuclease. In some embodiments, a CRISPR Cas9 polypeptide can be a Cas9 polypeptide from, for example, *Streptococcus* spp. (e.g., *S. pyogenes, S. thermophilus*), *Lactobacillus* spp., *Bifidobacterium* spp., *Kandleria* spp., *Leuconostoc* spp., *Oenococcus* spp., *Pediococcus* spp., *Weissella* spp., and/or *Olsenella* spp. Example Cas9 sequences include, but are not limited to, the amino acid sequences of SEQ ID NOs:59-60 or the polynucleotide sequences of SEQ ID NOs:61-71.

In some embodiments, the CRISPR-Cas effector protein may be a Cas9 polypeptide derived from *Streptococcus pyogenes* and recognizes the PAM sequence motif NGG, NAG, NGA (Mali et al, Science 2013; 339(6121): 823-826). In some embodiments, the CRISPR-Cas effector protein may be a Cas9 polypeptide derived from *Streptococcus thermophiles* and recognizes the PAM sequence motif NGGNG and/or NNAGAAW (W=A or T) (See, e.g., Horvath et al, Science, 2010; 327(5962): 167-170, and Deveau et al, J Bacteriol 2008; 190(4): 1390-1400). In some embodiments, the CRISPR-Cas effector protein may be a Cas9 polypeptide derived from Streptococcus mutans and recognizes the PAM sequence motif NGG and/or NAAR (R=A or G) (See, e.g., Deveau et al, *J BACTERIOL* 2008; 190(4): 1390-1400). In some embodiments, the CRISPR-Cas effector protein may be a Cas9 polypeptide derived from *Streptococcus aureus* and recognizes the PAM sequence motif NNGRR (R=A or G). In some embodiments, the CRISPR-Cas effector protein may be a Cas9 protein derived from *S. aureus*, which recognizes the PAM sequence motif N GRRT (R=A or G). In some embodiments, the CRISPR-Cas effector protein may be a Cas9 polypeptide derived from *S. aureus*, which recognizes the PAM sequence motif N GRRV (R=A or G). In some embodiments, the CRISPR-Cas effector protein may be a Cas9 polypeptide that is derived from *Neisseria meningitidis* and recognizes the PAM sequence motif N GATT or N GCTT (R=A or G, V=A, G or C) (See, e.g., Hou et ah, *PNAS* 2013, 1-6). In the aforementioned embodiments, N can be any nucleotide residue, e.g., any of A, G, C or T. In some embodiments, the CRISPR-Cas effector protein may be a Cas13a protein derived from Leptotrichia shahii, which recognizes a protospacer flanking sequence (PFS) (or RNA PAM (rPAM)) sequence motif of a single 3' A, U, or C, which may be located within the target nucleic acid.

In some embodiments, the CRISPR-Cas effector protein may be derived from Cas12a, which is a Type V Clustered Regularly Interspaced Short Palindromic Repeats (CRISPR)-Cas nuclease see, e.g., SEQ ID NOs:1-20). Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA, crRNA, crDNA, CRISPR array) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a effector protein/domain useful with this invention may be any known or later identified Cas12a polypeptide (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity, e.g., may have nickase activity.

Any deaminase domain/polypeptide useful for base editing may be used with this invention. In some embodiments, the deaminase domain may be a cytosine deaminase domain or an adenine deaminase domain. A cytosine deaminase (or cytidine deaminase) useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). Cytosine deaminases can catalyze the hydrolytic deamination of cytidine or deoxycytidine to uridine or deoxyuridine, respectively. Thus, in some embodiments, a deaminase or deaminase domain useful with this invention may be a cytidine deaminase domain, catalyzing the hydrolytic deamination of cytosine to uracil. In some embodiments, a cytosine deaminase may be a variant of a naturally-occurring cytosine deaminase, including but not limited to a primate (e.g., a human, monkey, chimpanzee, gorilla), a dog, a cow, a rat or a mouse. Thus, in some embodiments, an cytosine deaminase useful with the invention may be about 70% to about 100% identical to a wild type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%0, 90%, 91%, 92%, 93%, 94%, 95%, 96%, 97%, 98%, 99%, or 100% identical, and any range or value therein, to a naturally occurring cytosine deaminase).

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBECI, FERNY, and/or a CDA1, optionally a pmCDA1, an atCDA1 (e.g., At2g19570), and evolved versions of the same (e.g., SEQ ID NO:27, SEQ ID NO:28 or SEQ ID NO:29). In some embodiments, the cytosine deaminase may be an APOBEC1 deaminase having the amino acid sequence of SEQ ID NO:23. In some embodiments, the cytosine deaminase may be an APOBEC3A deaminase having the amino acid sequence of SEQ ID NO:24. In some embodiments, the cytosine deaminase may be an CDA1 deaminase, optionally a CDA1 having the amino acid sequence of SEQ ID NO:25. In some embodiments, the cytosine deaminase may be a FERNY deaminase, optionally a FERNY having the amino acid sequence of SEQ ID NO:26. In some embodiments, a cytosine deaminase useful with the invention may be about 70% to about 100% identical (e.g., 70%, 71%, 72%, 73%, 74%, 75%, 76%, 77%, 78%, 79% 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase (e.g., an evolved deaminase). In some embodiments, a cytosine deaminase useful with the invention may be about 70% to about 99.5% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of SEQ ID NO:23, SEQ ID NO:24, SEQ ID NO:25 or SEQ ID NO:26 (e.g., at least 80%, at least 85%, at least 90%, at least 92%, at least 95%, at least 96%, at least 97%, at least 98%, at least 99%, or at least 99.5% identical to the amino acid sequence of SEQ ID NO:23, SEQ ID NO:24, SEQ ID NO:25, SEQ ID NO:26, SEQ ID NO:27, SEQ ID NO:28 or SEQ ID NO:29). In some embodiments, a polynucleotide encoding a cytosine deaminase may be codon optimized for expression in a plant and the codon optimized polypeptide may be about 70% to 99.5% identical to the reference polynucleotide.

In some embodiments, a nucleic acid construct of this invention may further encode a uracil glycosylase inhibitor (UGI) (e.g., uracil-DNA glycosylase inhibitor) polypeptide/domain. Thus, in some embodiments, a nucleic acid construct encoding a CRISPR-Cas effector protein and a cytosine deaminase domain (e.g., encoding a fusion protein comprising a CRISPR-Cas effector protein domain fused to a cytosine deaminase domain, and/or a CRISPR-Cas effector protein domain fused to a peptide tag or to an affinity polypeptide capable of binding a peptide tag and/or a deaminase protein domain fused to a peptide tag or to an affinity polypeptide capable of binding a peptide tag) may further encode a uracil-DNA glycosylase inhibitor (UGI), optionally wherein the UGI may be codon optimized for expression in a plant. In some embodiments, the invention provides fusion proteins comprising a CRISPR-Cas effector polypeptide, a deaminase domain, and a UGI and/or one or more polynucleotides encoding the same, optionally wherein the one or more polynucleotides may be codon optimized for expression in a plant. In some embodiments, the invention provides fusion proteins, wherein a CRISPR-Cas effector polypeptide, a deaminase domain, and a UGI may be fused to any combination of peptide tags and affinity polypeptides as described herein, thereby recruiting the deaminase domain and UGI to the CRISPR-Cas effector polypeptide and a target nucleic acid. In some embodiments, a guide nucleic acid may be linked to a recruiting RNA motif and one or more of the deaminase domain and/or UGI may be fused to an affinity polypeptide that is capable of interacting with the recruiting RNA motif, thereby recruiting the deaminase domain and UGI to a target nucleic acid.

A "uracil glycosylase inhibitor" useful with the invention may be any protein that is capable of inhibiting a uracil-DNA glycosylase base-excision repair enzyme. In some embodiments, a UGI domain comprises a wild type UGI or a fragment thereof. In some embodiments, a UGI domain useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%9, 91%, 92%, 93%, 94%, 95%, 96%, 97%, 98%, 99%, 99.5% or 100% identical and any range or value therein) to the amino acid sequence of a naturally occurring UGI domain. In some embodiments, a UGI domain may comprise the amino acid sequence of SEQ ID NO:41 or a polypeptide having about 70% to about 99.5% sequence identity to the amino acid sequence of SEQ ID NO:41 (e.g., at least 80%, at least 85%, at least 90%, at least 92%, at least 95%, at least 96%, at least 97%, at least 98%, at least 99%, or at least 99.5% identical to the amino acid sequence of SEQ ID NO:41). For example, in some embodiments, a UGI domain may comprise a fragment of the amino acid sequence of SEQ ID NO:41 that is 100% identical to a portion of consecutive nucleotides (e.g., 10, 15, 20, 25, 30, 35, 40, 45, 50, 55, 60, 65, 70, 75, 80 consecutive nucleotides; e.g., about 10, 15, 20, 25, 30, 35, 40, 45, to about 50, 55, 60, 65, 70, 75, 80 consecutive nucleotides) of the amino acid sequence of SEQ ID NO:41. In some embodiments, a UGI domain may be a variant of a known UGI (e.g., SEQ ID NO:41) having about 70% to about 99.5% sequence identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% sequence identity, and any range or value therein) to the known UGI. In some embodiments, a polynucleotide encoding a UGI may be codon optimized for expression in a plant (e.g., a plant) and the codon optimized polypeptide may be about 70% to about 99.5% identical to the reference polynucleotide.

An adenine deaminase (or adenosine deaminase) useful with this invention may be any known or later identified adenine deaminase from any organism (see, e.g., U.S. Pat. No. 10,113,163, which is incorporated by reference herein for its disclosure of adenine deaminases). An adenine deaminase can catalyze the hydrolytic deamination of adenine or adenosine. In some embodiments, the adenine deaminase may catalyze the hydrolytic deamination of adenosine or deoxyadenosine to inosine or deoxyinosine, respectively. In some embodiments, the adenosine deaminase may catalyze the hydrolytic deamination of adenine or adenosine in DNA. In some embodiments, an adenine deaminase encoded by a nucleic acid construct of the invention may generate an A→G conversion in the sense (e.g., "+"; template) strand of the target nucleic acid or a T→C conversion in the antisense (e.g., "−", complementary) strand of the target nucleic acid.

In some embodiments, an adenosine deaminase may be a variant of a naturally-occurring adenine deaminase. Thus, in some embodiments, an adenosine deaminase may be about 70% to 100% identical to a wild type adenine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring adenine deaminase). In some embodiments, the deaminase or deaminase does not occur in nature and may be referred to as an engineered, mutated or evolved adenosine deaminase. Thus, for example, an engineered, mutated or evolved adenine deaminase polypeptide or an adenine deaminase domain may be about 70% to 99.9% identical to a naturally occurring adenine deaminase polypeptide/domain (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% identical, and any range or value therein, to a naturally occurring adenine deaminase polypeptide or adenine deaminase domain). In some embodiments, the adenosine deaminase may be from a bacterium, (e.g., *Escherichia coli, Staphylococcus aureus, Haemophilus influenzae, Caulobacter crescentus*, and the like). In some embodiments, a polynucleotide encoding an adenine deaminase polypeptide/domain may be codon optimized for expression in a plant.

In some embodiments, an adenine deaminase domain may be a wild type tRNA-specific adenosine deaminase domain, e.g., a tRNA-specific adenosine deaminase (TadA) and/or a mutated/evolved adenosine deaminase domain, e.g., mutated/evolved tRNA-specific adenosine deaminase domain (TadA*). In some embodiments, a TadA domain may be from *E. coli*. In some embodiments, the TadA may be modified, e.g., truncated, missing one or more N-terminal and/or C-terminal amino acids relative to a full-length TadA (e.g., 1, 2, 3, 4, 5, 6, 7, 8, 9, 10, 11, 12, 13, 14, 15, 6, 17, 18, 19, or 20 N-terminal and/or C terminal amino acid residues may be missing relative to a full length TadA. In some embodiments, a TadA polypeptide or TadA domain does not comprise an N-terminal methionine. In some embodiments, a wild type *E. coli* TadA comprises the amino acid sequence of SEQ ID NO:30. In some embodiments, a mutated/evolved *E. coli* TadA* comprises the amino acid sequence of SEQ ID NOs:31-40 (e.g., SEQ ID NOs:31, 32, 33, 34, 35, 36, 37, 38, 39 or 40). In some embodiments, a polynucleotide encoding a TadA/TadA* may be codon optimized for expression in a plant.

A cytosine deaminase catalyzes cytosine deamination and results in a thymidine (through a uracil intermediate), causing a C to T conversion, or a G to A conversion in the complementary strand in the genome. Thus, in some embodiments, the cytosine deaminase encoded by the polynucleotide of the invention generates a C→T conversion in the sense (e.g., "+"; template) strand of the target nucleic acid or a G→A conversion in antisense (e.g., "−", complementary) strand of the target nucleic acid.

In some embodiments, the adenine deaminase encoded by the nucleic acid construct of the invention generates an A→G conversion in the sense (e.g., "+"; template) strand of the target nucleic acid or a T→C conversion in the antisense (e.g., "−", complementary) strand of the target nucleic acid.

The nucleic acid constructs of the invention encoding a base editor comprising a sequence-specific nucleic acid binding protein and a cytosine deaminase polypeptide, and nucleic acid constructs/expression cassettes/vectors encoding the same, may be used in combination with guide nucleic acids for modifying target nucleic acid including, but not limited to, generation of C→T or G→A mutations in a target nucleic acid including, but not limited to, a plasmid sequence; generation of C→T or G→A mutations in a coding sequence to alter an amino acid identity; generation of C→T or G→A mutations in a coding sequence to generate a stop codon; generation of C→T or G→A mutations in a coding sequence to disrupt a start codon; generation of point mutations in genomic DNA to disrupt function; and/or generation of point mutations in genomic DNA to disrupt splice junctions.

The nucleic acid constructs of the invention encoding a base editor comprising a sequence-specific nucleic acid binding protein and an adenine deaminase polypeptide, and expression cassettes and/or vectors encoding the same may be used in combination with guide nucleic acids for modifying a target nucleic acid including, but not limited to, generation of A→G or T→C mutations in a target nucleic acid including, but not limited to, a plasmid sequence; generation of A→G or T→C mutations in a coding sequence to alter an amino acid identity; generation of A→G or T→C mutations in a coding sequence to generate a stop codon; generation of A→G or T→C mutations in a coding sequence to disrupt a start codon; generation of point mutations in genomic DNA to disrupt function; and/or generation of point mutations in genomic DNA to disrupt splice junctions.

The nucleic acid constructs of the invention comprising a CRISPR-Cas effector protein or a fusion protein thereof may be used in combination with a guide RNA (gRNA, CRISPR array, CRISPR RNA, crRNA), designed to function with the encoded CRISPR-Cas effector protein or domain, to modify a target nucleic acid. A guide nucleic acid useful with this invention comprises at least one spacer sequence and at least one repeat sequence. The guide nucleic acid is capable of forming a complex with the CRISPR-Cas nuclease domain encoded and expressed by a nucleic acid construct of the invention and the spacer sequence is capable of hybridizing to a target nucleic acid, thereby guiding the complex (e.g., a CRISPR-Cas effector fusion protein (e.g., CRISPR-Cas effector domain fused to a deaminase domain and/or a CRISPR-Cas effector domain fused to a peptide tag or an affinity polypeptide to recruit a deaminase domain and optionally, a UGI) to the target nucleic acid, wherein the target nucleic acid may be modified (e.g., cleaved or edited) or modulated (e.g., modulating transcription) by the deaminase domain.

As an example, a nucleic acid construct encoding a Cas9 domain linked to a cytosine deaminase domain (e.g., fusion protein) may be used in combination with a Cas9 guide nucleic acid to modify a target nucleic acid, wherein the cytosine deaminase domain of the fusion protein deaminates a cytosine base in the target nucleic acid, thereby editing the target nucleic acid. In a further example, a nucleic acid construct encoding a Cas9 domain linked to an adenine deaminase domain (e.g., fusion protein) may be used in combination with a Cas9 guide nucleic acid to modify a target nucleic acid, wherein the adenine deaminase domain of the fusion protein deaminates an adenosine base in the target nucleic acid, thereby editing the target nucleic acid.

Likewise, a nucleic acid construct encoding a Cas12a domain (or other selected CRISPR-Cas nuclease, e.g., C2c1, C2c3, Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5) linked to a cytosine deaminase domain or adenine deaminase domain (e.g., fusion protein) may be used in combination with a Cas12a guide nucleic acid (or the guide nucleic acid for the other selected CRISPR-Cas nuclease) to modify a target nucleic acid, wherein the cytosine deaminase domain or adenine deaminase domain of the fusion protein deaminates a cytosine base in the target nucleic acid, thereby editing the target nucleic acid.

A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof, a repeat of a Type II Cas9 CRISPR-Cas system, or fragment thereof, a repeat of a Type V C2c1 CRISPR Cas system, or a fragment thereof, a repeat of a CRISPR-Cas system of, for example, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5, or a fragment thereof), wherein the repeat sequence may be linked to the 5' end and/or the 3' end of the spacer sequence. The design of a gRNA of this invention may be based on a Type I, Type II, Type III, Type IV, Type V, or Type VI CRISPR-Cas system.

In some embodiments, a Cas12a gRNA may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (like in the MS2 recruitment strategy) or other RNA structures hanging off the spacer.

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas effector protein encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35 (Web Server issue):W52-7). In some embodiments, a repeat sequence or portion thereof is linked at its 3' end to the 5' end of a spacer sequence, thereby forming a repeat-spacer sequence (e.g., guide nucleic acid, guide RNA/DNA, crRNA, crDNA).

In some embodiments, a repeat sequence comprises, consists essentially of, or consists of at least 10 nucleotides depending on the particular repeat and whether the guide nucleic acid comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% sequence identity (e.g., at least about 90%, 91%, 92%, 93%, 94%, 95%, 96%, 97%, 98%, 99%, or more) to the same region (e.g., 5' end) of a wild type CRISPR Cas repeat nucleotide sequence. In some embodiments, a portion of a repeat sequence may comprise a pseudoknot-like structure at its 5' end (e.g., "handle").

A "spacer sequence" as used herein is a nucleotide sequence that is complementary to a target nucleic acid (e.g., target DNA) (e.g., protospacer) (e.g., complementary to consecutive nucleotides of a sequence having at least 90% sequence identity to a region or portion of an endogenous SGR gene, the endogenous SGR gene (a) having at least 90% sequence identity to any one of SEQ ID NOs:75-82; (b) comprising a sequence encoding a polypeptide, the polypeptide (i) having at least 95% sequence identity to the amino acid sequence of SEQ ID NO:73 or SEQ ID NO:74 and/or (ii) comprising any one of the amino acid sequences of SEQ ID NOs:83-89. In some embodiments, a spacer sequence may include, but is not limited to, the nucleotide sequences of any one of SEQ ID NOs:90-114. The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%⁰, 90%, 91%, 92%, 93%, 94%, 95%, 96%, 97%, 98%, 99%, or more)) to a target nucleic acid. Thus, in some embodiments, the spacer sequence can have one, two, three, four, or five mismatches as compared to the target nucleic acid, which mismatches can be contiguous or noncontiguous.

In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 21, 22, or 23 nucleotides in length.

In some embodiments, the 5' region of a spacer sequence of a guide nucleic acid may be identical to a target DNA, while the 3' region of the spacer may be substantially complementary to the target DNA (e.g., Type V CRISPR- Cas), or the 3' region of a spacer sequence of a guide nucleic acid may be identical to a target DNA, while the 5' region of the spacer may be substantially complementary to the target DNA (e.g., Type II CRISPR-Cas), and therefore, the overall complementarity of the spacer sequence to the target DNA may be less than 100%. Thus, for example, in a guide for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target tides (e.g., 16, 17, 18, 19, 20, 21, 22, 23, 24, 25, 26, 27, 28, 29, 30 nucleotides, and the like) located immediately adjacent to a PAM sequence.

A "protospacer sequence" refers to the target double stranded DNA and specifically to the portion of the target DNA (e.g., or target region in the genome) that is fully or substantially complementary (and hybridizes) to the spacer sequence of the CRISPR repeat-spacer sequences (e.g., guide nucleic acids, CRISPR arrays, crRNAs).

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

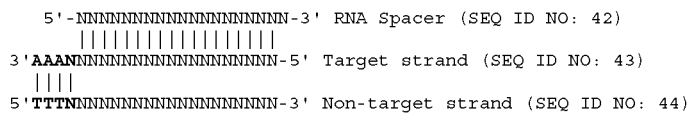

```
5'-NNNNNNNNNNNNNNNNNNNN-3'   RNA Spacer (SEQ ID NO: 42)
   ||||||||||||||||||||
3'AAANNNNNNNNNNNNNNNNNNNN-5' Target strand (SEQ ID NO: 43)
   ||||
5'TTTNNNNNNNNNNNNNNNNNNNN-3' Non-target strand (SEQ ID NO: 44)
```

DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA.

As a further example, in a guide for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or any range or value therein)) to the target DNA.

In some embodiments, a seed region of a spacer may be about 8 to about 10 nucleotides in length, about 5 to about 6 nucleotides in length, or about 6 nucleotides in length.

As used herein, a "target nucleic acid", "target DNA," "target nucleotide sequence," "target region," or a "target region in the genome" refers to a region of a plant's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide nucleic acid of this invention. A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome). A target region may be selected from any region of at least 15 consecutive nucleo- In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5'-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

In some embodiments, the present invention provides expression cassettes and/or vectors comprising the nucleic acid constructs of the invention (e.g, one or more components of an editing system of the invention). In some embodiments, expression cassettes and/or vectors comprising the nucleic acid constructs of the invention and/or one or more guide nucleic acids may be provided. In some embodiments, a nucleic acid construct of the invention encoding a base editor (e.g., a construct comprising a CRISPR-Cas effector protein and a deaminase domain (e.g., a fusion protein)) or the components for base editing (e.g., a CRISPR-Cas effector protein fused to a peptide tag or an affinity polypeptide, a deaminase domain fused to a peptide tag or an affinity polypeptide, and/or a UGI fused to a peptide tag or an affinity polypeptide), may be comprised on the same or on a separate expression cassette or vector from that comprising the one or more guide nucleic acids. When the nucleic acid construct encoding a base editor or the components for base editing is/are comprised on separate expression cassette(s) or vector(s) from that comprising the guide nucleic acid, a target nucleic acid may be contacted with (e.g., provided with) the expression cassette(s) or vector(s) encoding the base editor or components for base editing in any order from one another and the guide nucleic acid, e.g., prior to, concurrently with, or after the expression cassette comprising the guide nucleic acid is provided (e.g., contacted with the target nucleic acid).

Fusion proteins of the invention may comprise sequence-specific nucleic acid binding domains (e.g., sequence-specific DNA binding domains), CRISPR-Cas polypeptides, and/or deaminase domains fused to peptide tags or affinity polypeptides that interact with the peptide tags, as known in the art, for use in recruiting the deaminase to the target nucleic acid. Methods of recruiting may also comprise guide nucleic acids linked to RNA recruiting motifs and deaminases fused to affinity polypeptides capable of interacting with RNA recruiting motifs, thereby recruiting the deaminase to the target nucleic acid. Alternatively, chemical interactions may be used to recruit polypeptides (e.g., deaminases) to a target nucleic acid.

A peptide tag (e.g., epitope) useful with this invention may include, but is not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. Any epitope that may be linked to a polypeptide and for which there is a corresponding affinity polypeptide that may be linked to another polypeptide may be used with this invention as a peptide tag. In some embodiments, a peptide tag may comprise 1 or 2 or more copies of a peptide tag (e.g., repeat unit, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more repeat units. In some embodiments, an affinity polypeptide that interacts with/binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26(5): 910-924 (2017)); Gilbreth (*Curr Opin Struc Biol* 22(4):413-420 (2013)), U.S. Pat. No. 9,982,053, each of which are incorporated by reference in their entireties for the teachings relevant to affibodies, anticalins, monobodies and/or DARPins.

In some embodiments, a guide nucleic acid may be linked to an RNA recruiting motif, and a polypeptide to be recruited (e.g., a deaminase) may be fused to an affinity polypeptide that binds to the RNA recruiting motif, wherein the guide binds to the target nucleic acid and the RNA recruiting motif binds to the affinity polypeptide, thereby recruiting the polypeptide to the guide and contacting the target nucleic acid with the polypeptide (e.g., deaminase). In some embodiments, two or more polypeptides may be recruited to a guide nucleic acid, thereby contacting the target nucleic acid with two or more polypeptides (e.g., deaminases).

In some embodiments, a polypeptide fused to an affinity polypeptide may be a reverse transcriptase and the guide nucleic acid may be an extended guide nucleic acid linked to an RNA recruiting motif. In some embodiments, an RNA recruiting motif may be located on the 3' end of the extended portion of an extended guide nucleic acid (e.g., 5'-3', repeat-spacer-extended portion (RT template-primer binding site)-RNA recruiting motif). In some embodiments, an RNA recruiting motif may be embedded in the extended portion.

In some embodiments of the invention, an extended guide RNA and/or guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs.

In some embodiments, an RNA recruiting motif and corresponding affinity polypeptide may include, but is not limited to, a telomerase Ku binding motif (e.g., Ku binding hairpin) and the corresponding affinity polypeptide Ku (e.g., Ku heterodimer), a telomerase Sm7 binding motif and the corresponding affinity polypeptide Sm7, an MS2 phage operator stem-loop and the corresponding affinity polypeptide MS2 Coat Protein (MCP), a PP7 phage operator stem-loop and the corresponding affinity polypeptide PP7 Coat Protein (PCP), an SfMu phage Corn stem-loop and the corresponding affinity polypeptide Corn RNA binding protein, a PUF binding site (PBS) and the affinity polypeptide *Pumilio*/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide *Pumilio*/fem-3 mRNA binding factor (PUF).

In some embodiments, the components for recruiting polypeptides and nucleic acids may those that function through chemical interactions that may include, but are not limited to, rapamycin-inducible dimerization of FRB-FKBP; Biotin-streptavidin; SNAP tag; Halo tag; CLIP tag; DmrA-DmrC heterodimer induced by a compound; bifunctional ligand (e.g., fusion of two protein-binding chemicals together; e.g. dihyrofolate reductase (DHFR).

In some embodiments, the nucleic acid constructs, expression cassettes or vectors of the invention that are optimized for expression in a plant may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%9, 90%, 91%, 92%, 93%, 94%, 95%, 96%, 97%, 98%, 99%, 99.5% or 100%) to the nucleic acid constructs, expression cassettes or vectors comprising the same polynucleotide(s) but which have not been codon optimized for expression in a plant.

Further provided herein are cells comprising one or more polynucleotides, guide nucleic acids, nucleic acid constructs, expression cassettes or vectors of the invention.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1. Design of the Editing Constructs for SGR1 and SGR2

Figure 2:
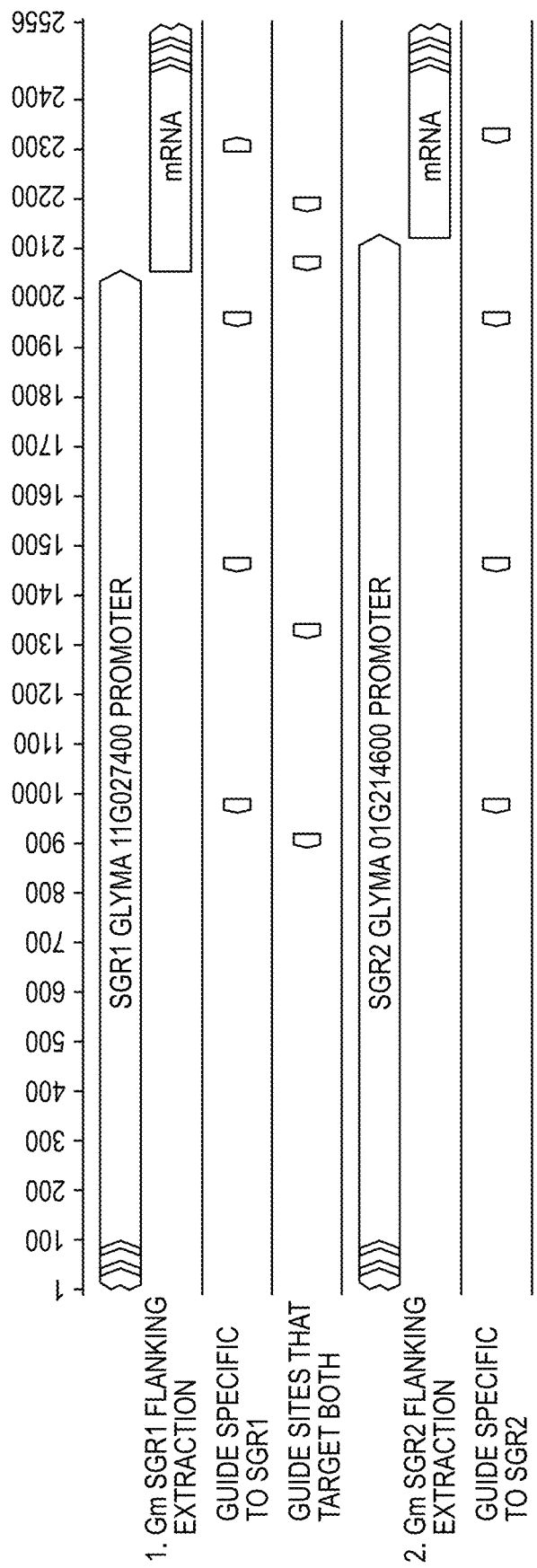
FIG. 2 provides exemplary target regions in SGR1 and SGR2 with example spacer sequences for use with guide nucleic acids.
Figure 3:
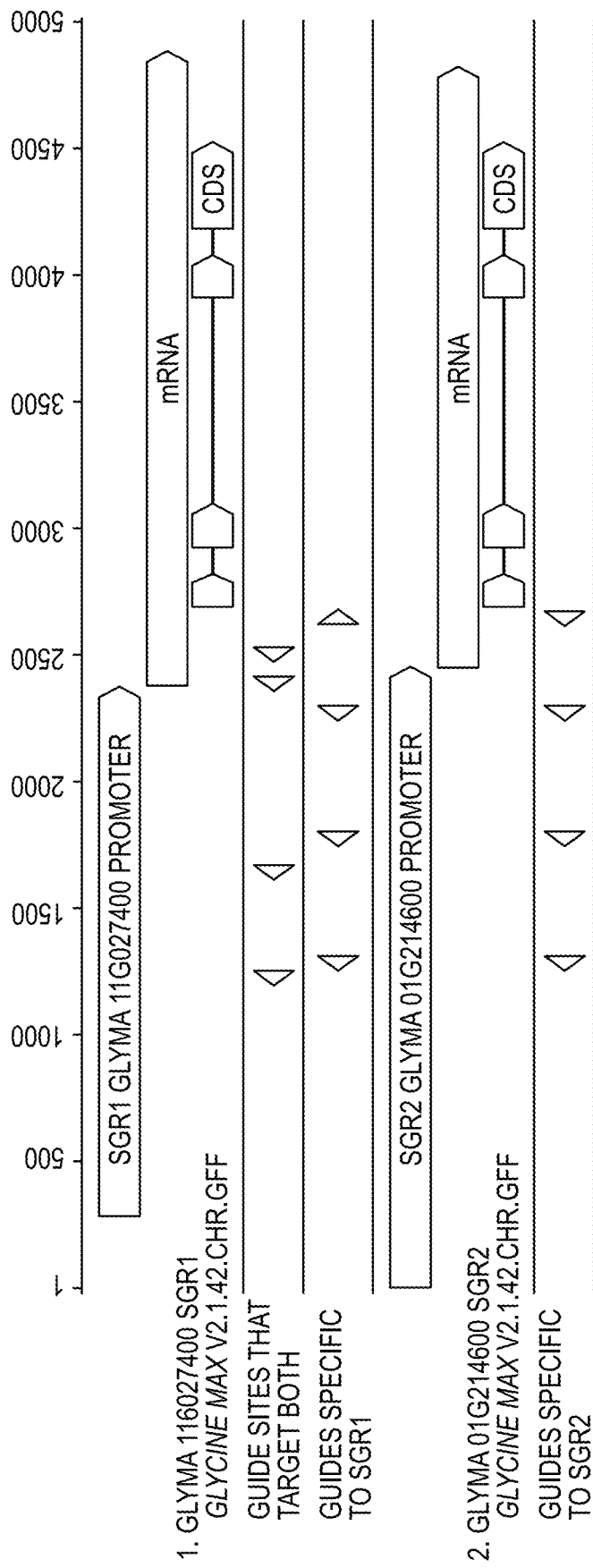
FIG. 3 provides an exemplary target region in SGR1 and SGR2 with example spacer sequences for use with guide nucleic acids.

A strategy of promoter editing (Rodriguez-Leal et al. *Cell* 171, 470-480.e8 (2017)) is employed to generate knockdowns of SGR1/2 to mitigate the risk of deleterious agronomic traits such as maturity and/or senescence delays that may accompany complete knockout of SGR1/2. A proprietary soybean line was selected for transformation and the genomic sequences of SGR1/2 were identified within this line. To generate a range of promoter alleles, multiple spacer sequences (SEQ ID NOs:90-114) were designed across the promoters of SGR1/2 and placed into one construct. Three additional and separate constructs were also designed to engineer more targeted promoter deletions (FIG. 1-3).

Figure 4:
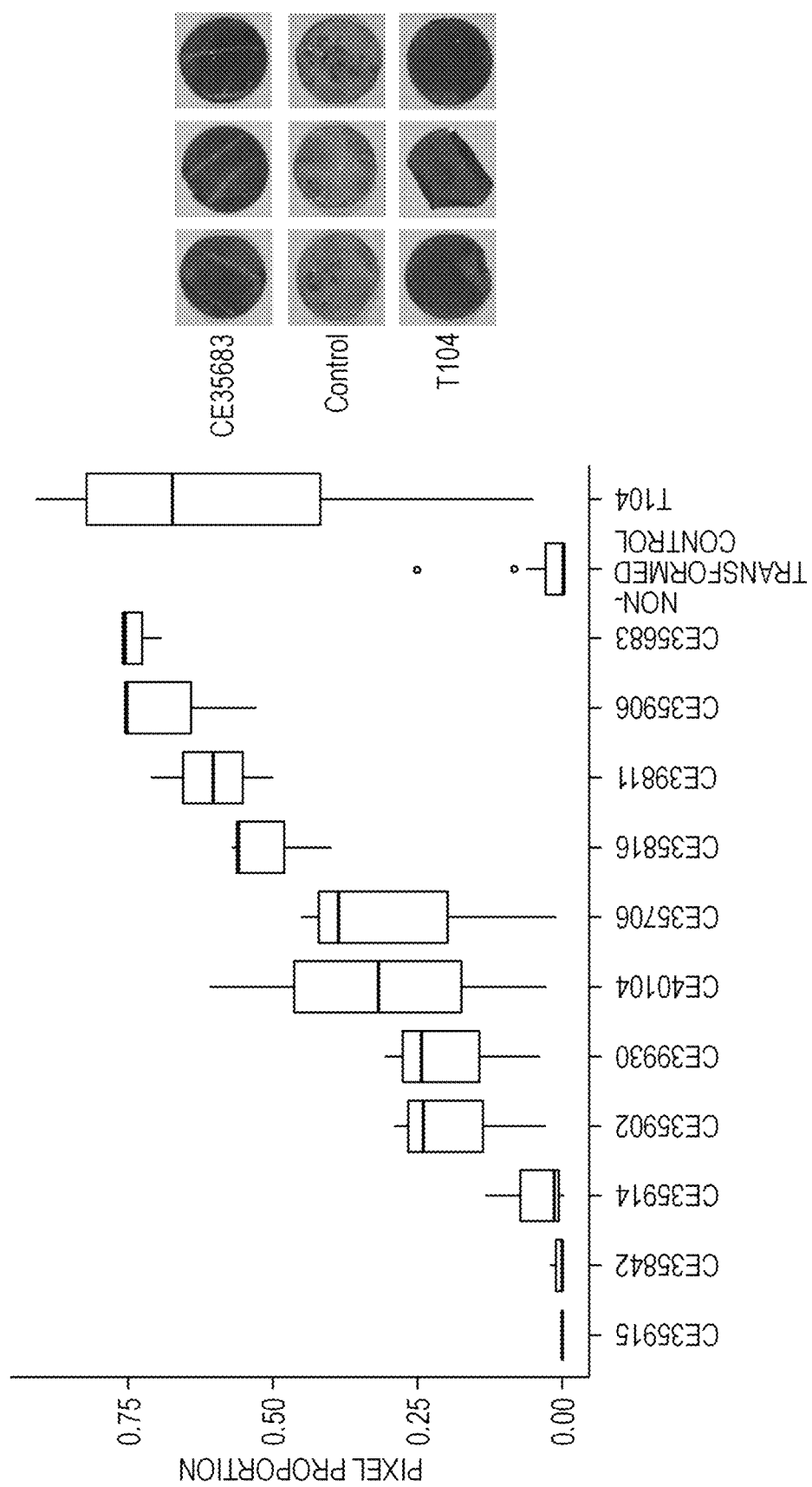
FIG. 4 shows the proportion of green pixels remaining in analyzed images of leaf punches incubated in the dark for 7 days. Boxes for edited lines beginning with "CE" represent proportions calculated from three replicate punches from each plant. Boxes for controls represent green pixel proportions calculated from 8-10 replicate plants. The panel on the right provides example leaf punches after 7 days in the dark from one edited line with trait activity (CE35683), control, and T104. See, Table 3 for the edit call for each edited plant; also provided is a non-transformed control and T104, which is a sgr1sgr2 double null.
Figure 5:
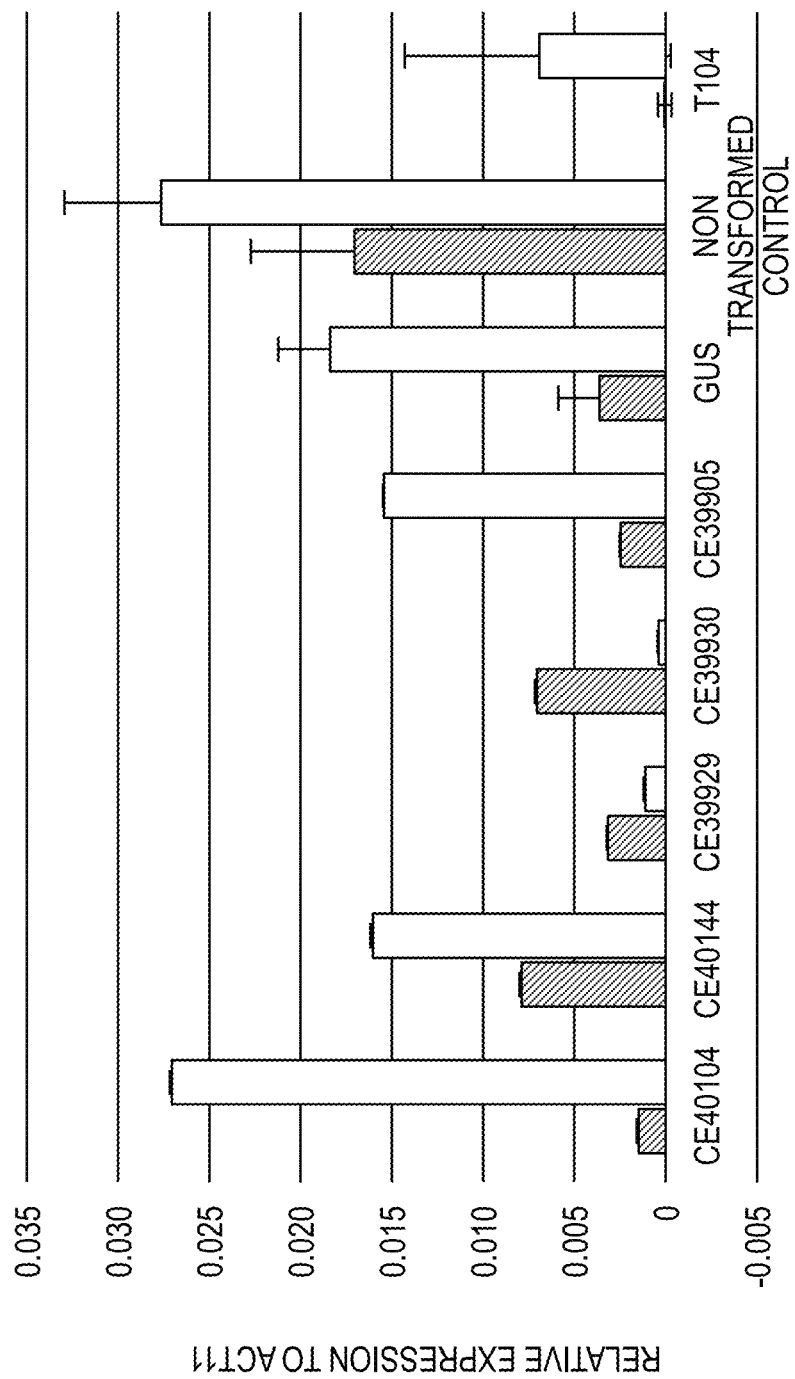
FIG. 5 shows the relative expression of SGR1 and SGR2 in select edited lines. Error bars on control genotypes represent 95% confidence intervals calculated from eleven biological replicates for GUS (transformation control), four from the non-transformed control, and four from T104 (sgr1sgr2 null). The table in the panel on the right indicates edit zygosity and size of the deletions. See, Table 3 for the edit call for each edited plant (this data is not available for CE40144, CE39929, CE39905; also provided is a GUS control, a non-transformed control and T104, which is a sgr1sgr2 double null.

Vectors encoding the spacer as well as a CRISPR-Cas effector were introduced into soy using *Agrobacterium* (Table 2). Transformed tissue was maintained in vitro with antibiotic selection to regenerate positive transformants. Tissue was collected from regenerating plants (E0 generation) for DNA extraction and subsequent molecular screening was employed to identify E0 plants carrying deletions in the promoters of both SGR1 and SGR2. Edited lines were maintained in the greenhouse and selfed to generate E1 seed. E1 seed was sown and plants were grown for two weeks in growth chambers, and then sampled for molecular screening to identify transgene free plants and determine edit zygosity. A dark-induced leaf senescence assay was used to identify E1 plants that showed chlorophyll retention in the dark as these plants contained edits that substantially altered SGR1/2 expression (FIG. 4, Table 3). Expression level of SGR1/2 was assayed in a subset of lines that showed a range of phenotypes and edit types (FIG. 5).

Example 2. Phenotypic Testing of E1 and E2 Generation for Leaf Senescence

Expression level screening was performed on homozygous edited E1 plants to determine lines with acceptable knockdown levels (25-75%) of SGR1/2. All E1 lines with acceptable knockdown levels were phenotyped for days to first flowering, as well as days to maturity (stage R7) in growth chamber conditions. Dark-induced leaf senescence in detached leaf assays and RGB imaging were performed in parallel to measure levels of chlorophyll retention. Lines with SGR1/2 knockdown and minimal senescence delays and chlorophyll retention were selfed to get E2 seeds. Homozygous E2 lines were then subjected to greenhouse screening with a panel of isolates as well as field screening.

Example 3. Phenotypic Testing of E2 Generation for Rust Control

E1 seeds were planted in a 36 well flat, allowed to germinate in the growth chamber, then moved to the greenhouse 1 week after planting. Control seeds were sown at the same time as edited seed. Wild type controls, including the sgr1sgr2 null line T104, were sown at the same time. Three weeks after planting, three leaf punches per plant were collected from a healthy V3 trifoliate leaf with a ¼ inch cork borer (FIG. 4, right panel). 1 leaf punch was placed per well in a 12 well plate containing 2 mL of strength Murashige and Skoog solution. Randomization was used to distribute each of the 3 biological replicates throughout the total plates used for an experiment. The plates were wrapped in aluminum foil and incubated in the dark at room temperature for 7 days. After 7 days, leaf punches were removed from the 12 well plate and imaged. A custom program was used to quantify green pixel counts in each image (FIG. 4, left panel).

A subset of E1 lines that showed reduced senescence in the above-described assay were then subjected to expression analysis to determine the impact of the SGR1/2 edits. Tissue from V3 leaves was collected for RNA extraction on the same day that leaf punches were taken for the senescence assay. RNA was extracted using the Qiagen RNeasy Mini Kit and cDNA was generated using the RevertAid First Strand cDNA Synthesis Kit. qRT-PCR was performed using SYBR Green reagents (Takara TB Green Premix) according to the manufacturer's protocol. The endogenous control ACTIN11 was used to analyze expression of SGR1/2 with the ΔCT method.

Figure 8:
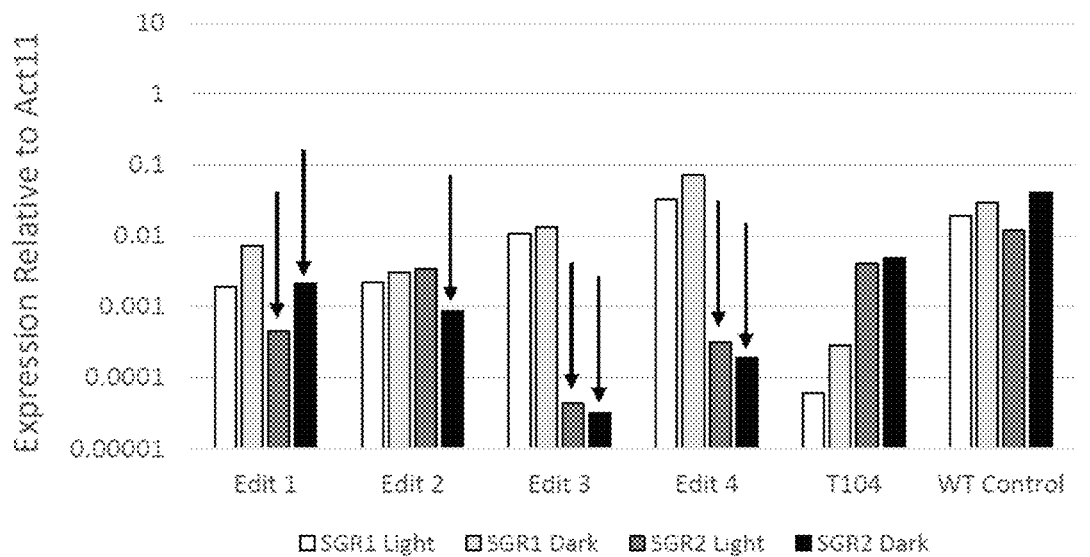
FIG. 8 provides bar graphs showing expression measurement of GmSGR1 and GmSGR2. Panel A shows prior to exposure to light treatment. Panel B shows after 1 day of light treatment. Panel C shows after 5 days of light treatment. Panel D provides the genotypes of edited lines, listing sizes of deletions induced in GmSGR promoters via gene editing Bars indicate relative expression of SGR1 or SGR2, relative to the housekeeping gene GmACT11. Bars are color-coded to indicate SGR family member and which treatment the sample represents. Arrows indicate edited samples where a greater than 10-fold reduction in expression was observed relative to the WT Control sample. Each panel indicates expression of four edited genotypes, T104 (a soy line with strong staygreen phenotype and sgr1sgr2 mutations), and WT control.
Figure 8:
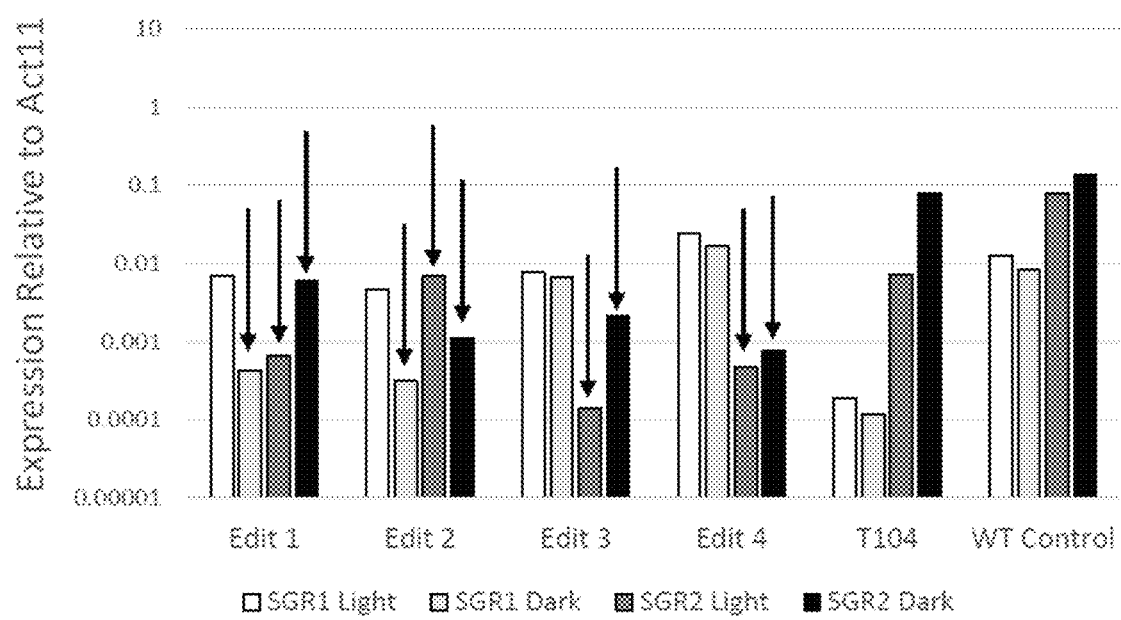
Figure 8:
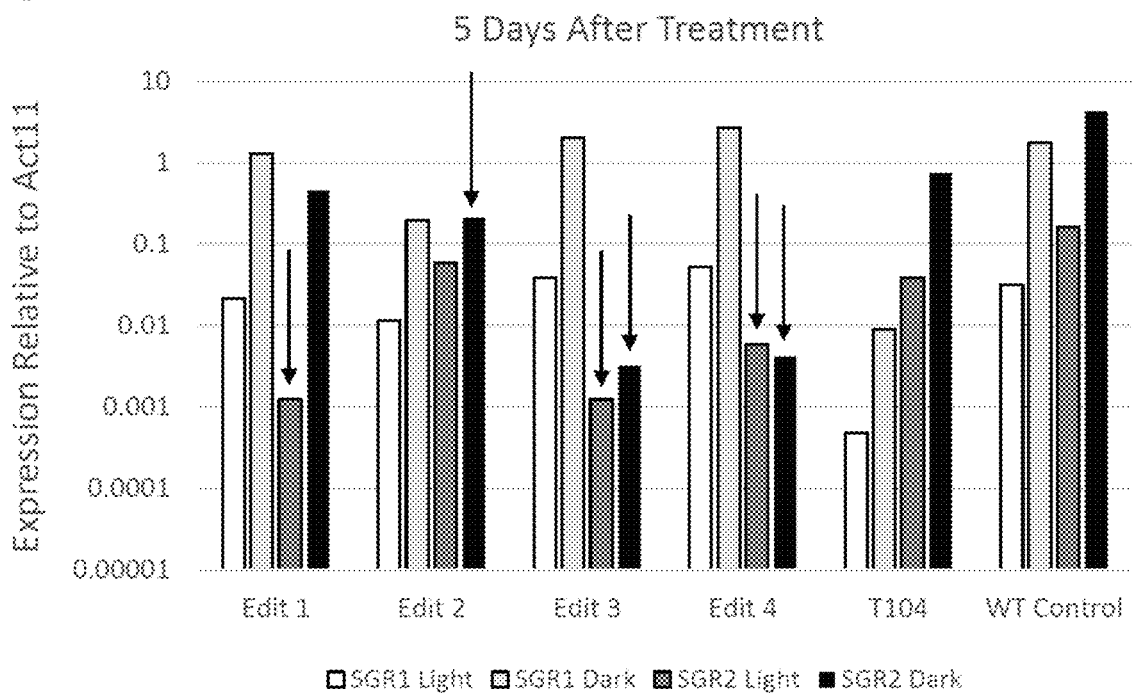

Two E1 lines that were homozygous for large deletions in SGR2 but heterozygous for large deletions in SGR1 were grown another generation to isolate homozygous edited lines (Table 3) that contain large deletions in both promoters. SGR1/2 homozygous edited E2 lines were then subjected to whole plant dark treatment for 5 days. Tissue was collected on day 0, 1, and 5 of the dark-treatment, including from light-grown controls, and used for RNA extraction and SGR1/2 expression analysis as described above (FIG. 8).

Example 3. Phenotypic Testing of E2 Generation for Rust Control

Figure 6:
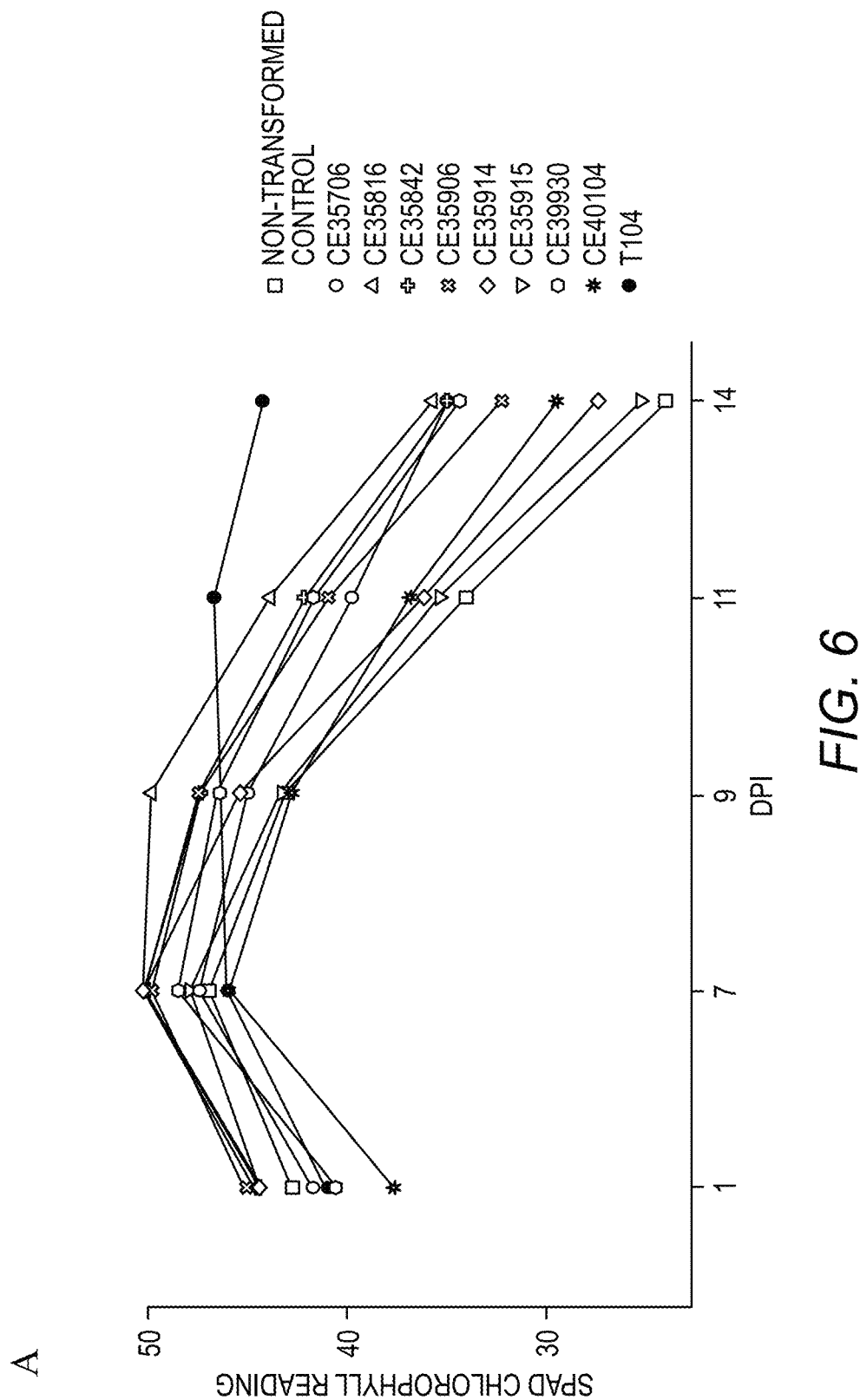
FIG. 6 shows the average chlorophyll SPAD chlorophyll readings during a soy rust infection time course (panel A). Each data point is comprised of eight replicates with ratings per replicate. Statistical analysis is shown in panel B. DPI=days post infection FIG. 7 provides percent severity ratings at 14 DPI. DPI=days post infection. See, Table 3 for the edit call for each edited plant; also provided is a non-transformed control and T104, which is a sgr1sgr2 double null.
Figure 7:
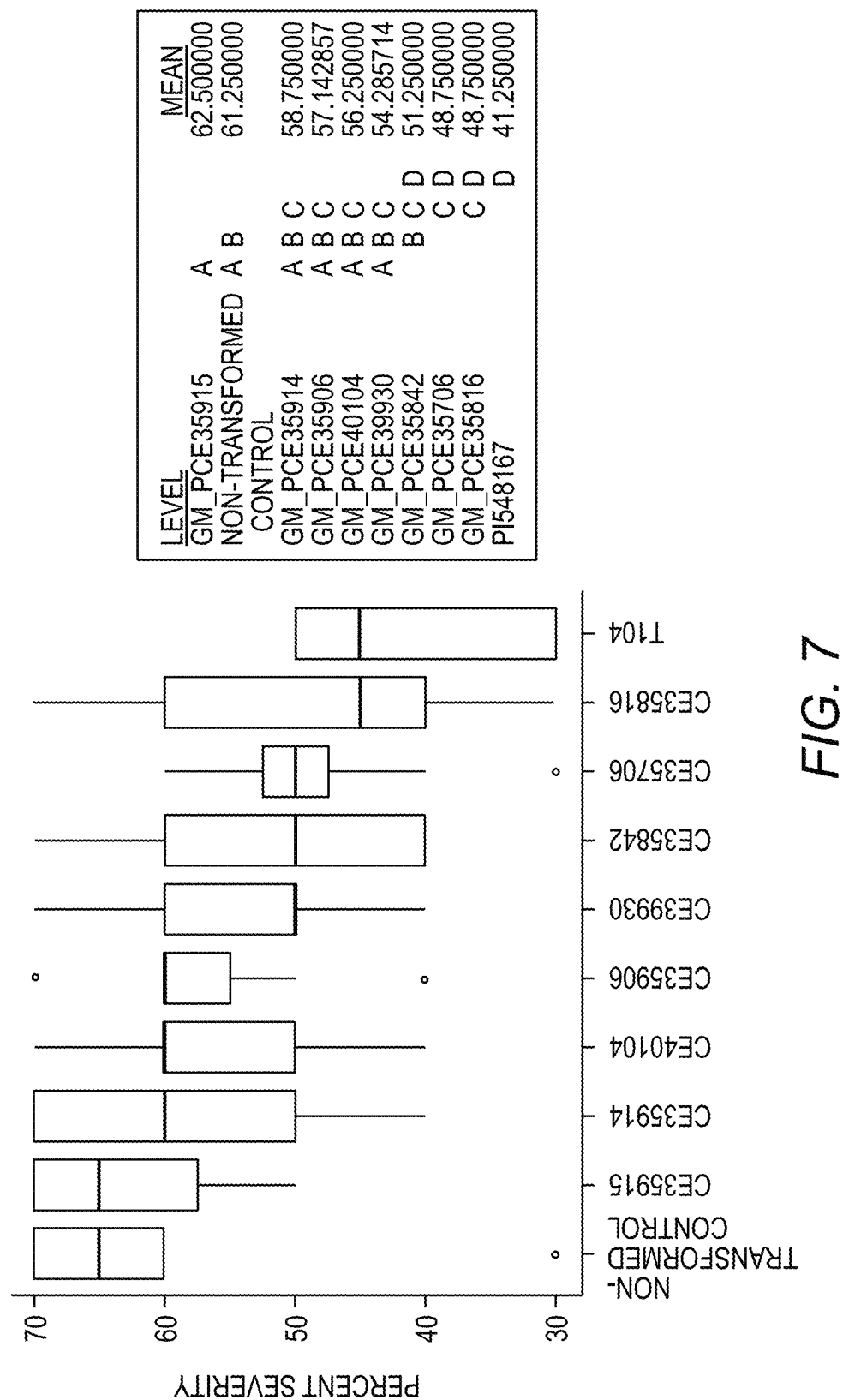

E2 seeds were planted in 3×2.5" pots with Berger BM2 potting media. Two checks were utilized: WT Soy (transformation line/susceptible check) and T104 (resistant check; e.g., non-chlorophyll degrading control plant or control plant having increased resistance to chlorophyll degradation) and 8 edited lines. Each entry was replicated in 8 pots. Plants were inoculated with an airbrush sprayer at the V2 stage on the 1st trifoliate with the causal agent of Asian soybean rust, *Phakopsora pachyrhizi*, at a rate of 20,000 urediniospores per mL. Spores used for inoculum were fresh from a previous generation of stock plants. After inoculation, plants were incubated in a dark mist box at 100% RH for 24 hours and then returned to a growth chamber set at the following: 14 hour light cycle, 500 uE light intensity 24 C day/20 C night, and 80% RH. Percent disease was rated visually on each inoculated trifoliate 14 days post inoculation. Chlorophyll readings were taken on the middle leaf of the inoculated trifoliate of each replicate for each entry at 1, 7, 9, 11, and 14 days post inoculation (DPI). For each middle leaf, 4 measurements were taken in a similar location for each replicate and entry. Chlorophyll readings were taken with a Konica Minolta chlorophyll meter, model SPAD-502. Results are shown in FIGS. 6-7.

TABLE 1

Edited genes and SEQ ID NOs

| SEQ ID NO | Edit(s) |
|---|---|
| 115 | CE35706-LOCUS27-1529:9D |
| 116 | CE35706-LOCUS28-2115:8D |
| 117 | CE35816-LOCUS27-1873:4D |
| 118 | CE35816-LOCUS27-2149:175D |

TABLE 1-continued

Edited genes and SEQ ID NOs

| SEQ ID NO | Edit(s) |
|---|---|
| 119 | CE35816-LOCUS28-1894:5D |
| 120 | CE35842-LOCUS27-1871:13D |
| 121 | CE35842-LOCUS28-1240:256D |
| 122 | CE35902-LOCUS27-692:1147D |
| 123 | CE35902-LOCUS28-1249:5D |
| 124 | CE35902-LOCUS28-1871:13D |
| 125 | CE35906-LOCUS27-692:1147D |
| 126 | CE35914-LOCUS27-1357:3D |
| 127 | CE35914-LOCUS27-1849:30D |
| 128 | CE35914-LOCUS28-1036:226D, 1362:126D |
| 129 | CE35914-LOCUS28-1862:106D |
| 130 | CE35915-LOCUS27-1356:5D |
| 131 | CE35915-LOCUS27-1839:6I, 1852:70D |
| 132 | CE35915-LOCUS28-1238:15D |
| 133 | CE35915-LOCUS28-1894:5D |
| 134 | CE39930-LOCUS27-1833:347D |
| 135 | CE39930-LOCUS28-1940:62D |
| 136 | CE40104-LOCUS27-1355:8D |
| 137 | CE40104-LOCUS27-1863:17D |
| 138 | CE40104-LOCUS28-1243:8D |
| 139 | CE40104-LOCUS28-1873:250D |
| 140 | CE70075-LOCUS27-1477:734D |
| 141 | CE70075-LOCUS28-1884:18D, 1942:330D |
| 142 | CE70109-LOCUS28-2115:8D |
| 143 | CE70110-LOCUS27-1873:692D |
| 144 | CE70110-LOCUS28-2006:111D |
| 145 | GLYMA_01G214600_SGR2_LOCUS27 (WT) |
| 146 | GLYMA_11G027400_SGR1_LOCUS28 (WT) |

TABLE 2

Vectors used in transformation

| Vector | Spacers | Target | Sequence |
|---|---|---|---|
| pWISE425 | PWsp184 | SGR1/2 | TTGTGCATTATTATTATGCCATT (SEQ ID NO: 90) |
|  | PWsp185 | SGR1 | GAATTCAAAAGAAAAACATAAGG (SEQ ID NO: 101) |
|  | PWsp186 | SGR2 | GAATTCAAAAGAAAAACACAAGG (SEQ ID NO: 100) |
|  | PWsp187 | SGR1/2 | GAAAATAATTTTCTCAAGTACCC (SEQ ID NO: 109) |
|  | PWsp188 | SGR1 | TTCTACAATTTTGACTACATTCA (SEQ ID NO: 94) |
|  | PWsp189 | SGR2 | TTCTACAATTTTGACTACTTTCA (SEQ ID NO: 95) |
|  | PWsp190 | SGR1 | CGCTACCCACGTGGTTTGGTTTC (SEQ ID NO: 107) |
|  | PWsp191 | SGR2 | CACTATCCACGTGGTATGGTTGC (SEQ ID NO: 104) |
|  | PWsp192 | SGR1/2 | AGTCGTAGCCTTGGTTGTGTTGT (SEQ ID NO: 91) |
|  | PWsp193 | SGR1/2 | CTTGTGAGCTTCAACAATGAAAA (SEQ ID NO: 108) |
|  | PWsp194 | SGR1 | CTTCATCAAGGTACTGTTTGATC (SEQ ID NO: 99) |
|  | PWsp195 | SGR2 | AGGGAAGATGAAACAGTAGTACC (SEQ ID NO: 103) |
| pWISE427 | PWsp187 | SGR1/2 | GAAAATAATTTTCTCAAGTACCC (SEQ ID NO: 109) |
|  | PWsp190 | SGR1 | CGCTACCCACGTGGTTTGGTTTC (SEQ ID NO: 107) |
|  | PWsp191 | SGR2 | CACTATCCACGTGGTATGGTTGC (SEQ ID NO: 104) |
|  | PWsp200 | SGR1 | GAAGAAAGTCATTACGTATCTTG (SEQ ID NO: 93) |
|  | PWsp201 | SGR2 | GAAGAAAGTCATCACATATCTTG (SEQ ID NO: 92) |
|  | PWsp202 | SGR1 | CCCAATTGGCGGTACACCAAATT (SEQ ID NO: 98) |
|  | PWsp203 | SGR2 | GAGTACCGCCAATTAGGGCAACC (SEQ ID NO: 110) |
| pWISE428 | PWsp190 | SGR1 | CGCTACCCACGTGGTTTGGTTTC (SEQ ID NO: 107) |
|  | PWsp191 | SGR2 | CACTATCCACGTGGTATGGTTGC (SEQ ID NO: 104) |
|  | PWsp194 | SGR1 | CTTCATCAAGGTACTGTTTGATC (SEQ ID NO: 99) |
|  | PWsp195 | SGR2 | AGGGAAGATGAAACAGTAGTACC (SEQ ID NO: 103) |
|  | PWsp203 | SGR2 | GAGTACCGCCAATTAGGGCAACC (SEQ ID NO: 110) |
|  | PWsp204 | SGR1 | GCTTGTAATGGTGGCTCCGCCTC (SEQ ID NO: 102) |
|  | PWsp205 | SGR1 | AGTCCTCAAAGATTGGAACAACA (SEQ ID NO: 96) |
|  | PWsp206 | SGR2 | ATCTTCCCTCAAAGATTGGAACA (SEQ ID NO: 97) |

TABLE 3

Obtained SGR1 and SGR2 alleles. Edit Calls represent the nucleotide position before the edit starts.

| CE ID | Vector | SGR1 Edit Call | SGR2 Edit Call | SEQ ID NOS |
|---|---|---|---|---|
| CE35915 | pWISE427 | hom 1238:15D, hom 1894:5D | hom 1356:5D, hom 1839:6I, 1852:70D | 132, 133, 130, 132 |
| CE35842 | pWISE427 | hom 1240:256D | hom 1871:13D | 121, 120 |
| CE35914 | pWISE427 | hom 1036:226D, hom 1362:126D, hom 1862:106D | hom 1357:3D, hom 1849:30D | 128, 129, 126, 127 |
| CE35902 | pWISE427 | hom 1249:5D, hom 1871:13D | hom 692:1147D | 123, 124, 122 |
| CE39930 | pWISE428 | hom 1940:62D | hom 1833:347D | 135, 134 |
| CE40104 | pWISE428 | hom 1243:8D, hom 1873:250D | hom 1355:8D, hom 1863:17D | 138, 139, 136, 137 |
| CE35706 | PWISE425 | hom 2115:8D | hom 1529:9D | 116, 115 |
| CE35816 | PWISE425 | hom 1894:5D | hom 1873:4D, hom 2149:175D | 119, 117, 118 |
| CE39811* | pWISE428 | het 1938:7D, het 1884:18D, het 1942:330D | hom 1477:734D | Not available |
| CE35906 | PWISE427 | Unedited | hom 692:1147D | 125 |
| CE35683* | PWISE425 | het 2006:111D, het 2116:8D | hom 1873:692D | Not available |
| CE70110 | pWISE428 | hom 2006:111D | hom 1873:692D | 144, 143 |
| CE70075 | pWISE428 | hom 1884:18D, hom 1942:330D | hom 1477:734D | 141, 140 |

D—Deletion, I—Insertion *Indicates plants that were grown another generation to isolate progeny that were homozygous edited for the larger deletions in SGR1.

The foregoing is illustrative of the present invention and is not to be construed as limiting thereof. The invention is defined by the following claims, with equivalents of the claims to be included therein.

SEQUENCE LISTING (146 sequences)

SEQ ID NO: 1 - protein, 1228 aa, Lachnospiraceae sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 4 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 5 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 6 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 7 - protein, 1206 aa, Lachnospiraceae sp.
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 8 - protein, 1233 aa, Lachnospiraceae sp.
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 9 - protein, 1227 aa, Lachnospiraceae sp.
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 10 - protein, 1264 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 11 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 12 - protein, 1352 aa, Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 13 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 14 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 15 - protein, 1484 aa, Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 16 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 17 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 18 - DNA, 3987 bp, Artificial sequence
  Synthetic polynucleotide
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 19 - DNA, 3987 bp, Artificial sequence
  Synthetic polynucleotide
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 20 - DNA, 3987 bp, Artificial sequence
  Synthetic polynucleotide
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 21 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 22 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 23 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 24 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 25 - DNA, 621 bp, Petromyzon marinus
acagatgcagagtatgtgagaattcacgaaaagctggacatctataccttcaagaagcagttctttaacaataagaagtctgtgagccataggtgctacgtgctgttcgagctgaagagaaggggtgaaagaagggcatgtttttgggggtatgctgtgaacaagccccagtctggaactgagagaggcattcacgccgaaattttcagcatcagaaaggtggaggaatacctgagggataaccctggacagtttacaattaattggtattctagctggtctccatgcgctgactgtgccgagaagatcctggaatggtacaaccaggagctgagaggaaatggccataccctgaagatttgggcctgcaagctgtactatgaaaagaacgcaagaaatcagatcggactgtggaacctgagggataatggtgtggggctgaacgtgatggtgtccgagcactatcagtgctgtagaaagattttcattcagtcctcacataatcagctgaacgagaatagatggctggaaaagactctgaagagggctgagaagagaaggtccgaactgtcaattatgatccaggtgaagatcctgcacaccactaagtcacctgccgtg

SEQ ID NO: 26 - protein, 160 aa, Artificial sequence
  Synthetic polypeptide
FERNYDPRELRKETYLLYEIKWGKSGKLWRHWCQNNRTQHAEVYFLENIFNARRFNPSTHCSITWYLSWSPCAECSQKIVDFLKEHPNVLEIYVARLYYHEDERNRQGLRDLVNSGVTIRIMDLPDYNYCWKTFVSDQGGDEDYWPGHFAPWIKQYSLKL

SEQ ID NO: 27 - protein, 207 aa, Artificial sequence
  Synthetic polypeptide
TDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 28 - protein, 228 aa, Artificial sequence
  Synthetic polypeptide
SSKTGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPNVTLFIYIARLYHLANPRNRQGLRDLISSGVTIQIMTEQESGYCWHNFVNYSPSNESHWPRYPHLWVRLYVLELYCIILGLPPCLNILRRKQSQLTSFTIALQSCHYQRLPPHILWATGLK

SEQ ID NO: 29 - protein, 162 aa, Artificial sequence
  Synthetic polypeptide
SFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 30 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 31 - protein, 166 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 32 - protein, 166 aa, Artificial sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 33 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 34 - protein, 166 aa, Artificial sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 35 - protein, 1763 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1565 aa, Artificial sequence
  Synthetic polypeptide
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 364 aa, Artificial sequence
  Synthetic polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 39 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 40 - protein, 167 aa, Artificial sequence
  Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 41 - protein, 83 aa, Bacillus phage AR9
TNLSDIIEKETGKQLVIQESILMLPEEVEEVIGNKPESDILVHTAYDESTDENVMLLTSDAPEYKPWALVIQDSNGENKIKML

SEQ ID NO: 42 - RNA, 19 nt, Artificial sequence
  Synthetic oligonucleotide
  misc_feature (1)..(19): n is a, c, g, or u
nnnnnnnnnnnnnnnnnnn

SEQ ID NO: 43 - DNA, 22 bp, Artificial sequence
  Synthetic oligonucleotide
  misc_feature (4)..(22): n is a, c, g, or t
aaannnnnnnnnnnnnnnnnnn

SEQ ID NO: 44 - DNA, 22 bp, Artificial sequence
  Synthetic oligonucleotide
  misc_feature (4)..(22): n is a, c, g, or t
tttnnnnnnnnnnnnnnnnnnn

SEQ ID NO: 45 - protein, 24 aa, Artificial sequence
  Synthetic peptide
EELLSKNYHLENEVARLKKGSGSG

SEQ ID NO: 46 - protein, 241 aa, Artificial sequence
  Synthetic polypeptide
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 47 - protein, 277 aa, Artificial sequence
  Synthetic polypeptide
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 48 - DNA, 66 bp, Saccharomyces bayanus
ttcttgtcgtacttatagatcgctacgttatttcaattttgaaaatctgagtcctgggagtgcgga

SEQ ID NO: 49 - protein, 605 aa, Homo sapiens
MSGWESYYKTEGDEEAEEEQEENLEASGDYKYSGRDSLIFLVDASKAMFESQSEDELTPFDMSIQCIQSVYISKIISSDRDLLAWFYGTEKDKNSVNFKIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPLKEACRAYGLKSGLKKQELLEALTKHFQD

SEQ ID NO: 50 - protein, 482 aa, Artificial sequence
  Synthetic polypeptide
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 51 - DNA, 10 bp, Methanobacterium thermoautotrophicum
aatttttgga

SEQ ID NO: 52 - protein, 83 aa, Methanobacterium thermoautotrophicum
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 53 - DNA, 25 bp, Bacteriophage MS2
gcgcacatgaggatcacccatgtgc

SEQ ID NO: 54 - protein, 116 aa, Bacteriophage MS2
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 55 - DNA, 26 bp, Bacteriophage PP7
ataaggagtttatatggaaaccctta

SEQ ID NO: 56 - protein, 127 aa, Bacteriophage PP7
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 57 - DNA, 19 bp, Shigella phage
ctgaatgcctgcgagcatc

SEQ ID NO: 58 - protein, 62 aa, Shigella phage
MKSIRCKNCNKLLFKADSFDHIEIRCPRCKRHIIMLNACEHPTEKHCGKREKITHSDETVRY

SEQ ID NO: 59 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 60 - protein, 1367 aa, Artificial sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 61 - DNA, 4101 bp, Artificial sequence
  Synthetic polynucleotide
gacaagaagtacagcatcgggctggcgatcgggaccaactccgtcggctgggctgtgattaccgacgagtacaaggtgccatccaagaagttcaaggtcctcggcaacactgaccggcacagcattaagaagaacctgattggggcgctgctgttcgattcgggggagactgcggaggcgaccaggctgaagcggactgcgcgccggaggtacaccaggaggaagaatcggatctgctacctccaggagattttctcgaatgagatggccaaggtggacgattccttcttccatcgcctggaggagtcgttcctcgttgaggaggacaagaagcatgagaggcatcccattttcgggaatatcgttgacgaggtggcttaccatgagaagtacccgaccatctaccatctgcggaagaagctcgtcgattcgaccgataaggccgacctgcggctgatctacctggccctcgcgcacatgattaagttccggggccatttcctcatcgagggcgacctcaacccggacaactcggacgtggataagctcttcattcagctcgtgcagacatacaaccagctcttcgaggagaatcccattaacgcctcgggggtcgacgctaaggctattctctcggctcggctgtcgaagtcgcgccggctggagaatctcattgcccagctcccaggcgagaagaagaacggcctcttcggcaacctgattgccctgtcgctggggctcacaccgaatttcaagtcgaacttcgacctcgccgaggacgctaagctccagctcagcaaggatacttacgatgatgacctcgataacctgctcgcccagattggggatcagtacgcggatctgttcctcgcggccaagaatctcagcgatgctattctcctgtcggacattctccgcgtcaacacagagattactaaggccccactgtcggcgagcatgattaagaggtacgatgagcatcatcaggacctgacactgctcaaggcgctggtccggcagcagctccccgagaagtacaaggagattttcttcgatcagtcaaagaatgggtacgcgggctacattgatggcggcgcgtcccaggaggagttctacaagttcattaagcccatcctggagaagatggacgggaccgaggagctgctggtgaagctcaatcgggaggacctgctccggaagcagcgcacattcgacaatggctcgattcctcaccagattcacctgggcgagctgcacgccattctccgcaggcaggaggacttctacccgttcctcaaggacaaccgcgagaagatcgagaagatcctgaccttccggattccatactacgtggggccgctcgcgcgggggaactcccggttcgcgtggatgactcgcaagtccgaagaaacgattacaccgtggaatttcgaggaggtcgtcgacaagggcgctagtgcgcagtcattcattgagaggatgaccaatttcgataagaacctgcctaacgagaaggtgctgccgaagcattcgctgctctacgagtacttcaccgtttacaatgagctgaccaaggtgaagtatgtgactgagggcatgaggaagccagcgttcctgagcggcgagcagaagaaggctatcgtggacctgctcttcaagactaaccggaaggtgactgtgaagcagctcaaggaggactacttcaagaagattgagtgcttcgattccgttgagattagcggggtggaggatcggttcaatgcttcgctcgggacataccacgatctcctgaagatcattaaggataaggacttcctcgacaacgaggagaacgaggacattctcgaagatattgtcctgaccctcaccctcttcgaggatcgggagatgatcgaggagaggctcaagacatacgctcatctgttcgatgataaggtcatgaagcagctgaagcgcaggcggtacacagggtgggggcggctgagccggaagctgatcaacgggattcgggataagcagtccgggaagacaattctcgacttcctcaagtccgacgggttcgctaaccggaacttcatgcagctcattcatgatgactcgctgacattcaaggaggatattcagaaggcgcaggtttcggggcagggcgactcgctccacgagcatattgcgaatctggcgggctcccccgcgattaagaagggcattctgcaaaccgtcaaggtggttgatgagctggtcaaggtcatggggcggcataagccagagaatattgtcatcgagatggcgcgggagaatcagaccacacagaaggggcagaagaactcacgggagcggatgaagcgcatcgaggagggcatcaaggagctggggtcgcagatcctgaaggagcatcccgtggagaacactcagctgcaaaatgagaagctgtacctctactacctccagaacgggagggacatgtatgtggatcaggagctggatattaataggctgagcgattacgatgtcgaccacattgtcccacagtcgttcctgaaggacgacagcattgacaacaaggtgctgacccgctcggataagaacaggggcaagagcgataatgttccaagcgaggaggttgtgaagaagatgaagaactactggcggcagctcctgaacgcgaagctcatcacacagcggaagttcgacaacctcaccaaggctgagcgcgggggcctgagcgagctggacaaggcggggttcattaagaggcagctggtcgagacacggcagattacaaagcatgttgcgcagattctcgattcccggatgaacaccaagtacgatgagaacgataagctgattcgggaggtcaaggtaattaccctgaagtccaagctggtgtccgacttcaggaaggacttccagttctacaaggttcgggagatcaacaactaccaccacgcgcatgatgcctacctcaacgcggtcgtggggaccgctctcatcaagaagtacccaaagctggagtcagagttcgtctacggggattacaaggtttacgacgtgcggaagatgatcgctaagagcgagcaggagattggcaaggctaccgctaagtacttcttctactccaacatcatgaacttcttcaagacagagattaccctcgcgaatggcgagatccggaagaggcccctcatcgagacaaatggggagacaggggagattgtctgggataaggggcgggatttcgcgaccgtccggaaggtcctgtcgatgccccaggttaatattgtcaagaagactgaggtccagactggcggcttctcaaaggagtcgattctcccaaagaggaactccgataagctcattgctcggaagaaggattgggaccccaagaagtacgggggattcgactcccccactgttgcttactctgttctggttgttgctaaggtggagaaggggaagtcgaagaagctgaagagcgtgaaggagctgctcgggattacaattatggagaggtcatccttcgagaagaatcccatcgacttcctggaggccaagggctacaaggaggtgaagaaggacctgattattaagctgcccaagtactcgctcttcgagctggagaatgggcggaagcggatgctggcgtccgcgggggagctgcaaaaggggaacgagctggcgctcccctccaagtatgtgaacttcctctacctggcgtcgcactacgagaagctgaaggggtccccagaggataatgagcagaagcagctcttcgtcgagcagcataagcactacctggacgagattatcgagcagattagcgagttctcgaagcgggtcatcctcgcggatgcgaacctggataaggtgctcagcgcctacaataagcaccgggacaagccgattcgggagcaggcggagaatattattcacctcttcacactcaccaacctcggggcaccagctgcgttcaagtacttcgacactactatcgaccggaagcggtacacctcgacgaaggaggtgctcgacgccaccctcattcaccagtcgatcacaggcctgtacgagacacggattgacctgtcccagctcgggggcgac

SEQ ID NO: 62 - DNA, 4101 bp, Artificial sequence
  Synthetic polynucleotide
gacaagaagtactccattggcctggcgattgggacaaactcggtggggtgggccgtgattacggatgagtacaaggttccaagcaagaagttcaaggtcctcgggaacacagatcggcattcgattaagaagaatctcattggggcgctcctcttcgactcgggggagacagcggaggctaccaggctcaagcggacagccaggcggcggtacacaaggcggaagaatcgcatctgctacctccaggagattttctcgaatgagatggcgaaggtggacgacagcttcttccatcggctggaggagtccttcctggtggaggaggataagaagcacgagaggcatccaattttcgggaacatcgtggacgaggttgcgtaccatgagaagtaccctacaatctaccatctgcggaagaagctggttgactccacagacaaggcggacctgaggctgatctacctcgctctggcccacatgattaagttccgcgggcatttcctgatcgagggggacctgaatcccgacaattcggatgtggacaagctcttcatccagctggtgcagacctacaaccagctgttcgaggagaatcccatcaatgcgtcgggcgttgacgctaaggccattctgtccgctaggctgtcgaagagcaggaggctggagaacctgatcgcccagctgccaggcgagaagaagaatgggctcttcgggaatctgattgcgctctccctggggctgacaccgaacttcaagagcaatttcgatctggctgaggacgcgaagctccagctctcgaaggacacttacgacgatgacctcgataacctcctcgcgcagatcggggaccagtacgctgatctcttcctcgccgctaagaacctctcggatgctatcctgctctccgacattctccgggttaataccgagattacaaaggccccactgtcggcgtccatgatcaagcggtacgatgagcatcatcaggatctcaccctgctcaaggccctcgtgcggcagcagctgcccgagaagtacaaggagattttcttcgaccagagcaagaatgggtacgctggctacattgacggcggggcctcacaggaggagttctacaagttcatcaagccaatcctggagaagatggatgggacagaggagctgctggtgaagctcaaccgggaggatctgctcaggaagcagcggacgttcgacaacgggtcgattccccatcagatccacctgggggagctgcacgcgatcctgcgccggcaggaggatttctaccctttcctgaaggataatcgggagaagatcgagaagattctcaccttccggattccctactacgtcgggccactcgcgcggggcaatagcaggttcgcctggatgacacggaagagcgaggagacaatcaccccctggaacttcgaggaggttgtcgacaagggggcgtccgcccagtcattcattgagcggatgaccaatttcgacaagaatctgccaaatgagaaggttctcccaaagcatagcctcctctacgagtacttcactgtttacaacgagctgaccaaggtgaagtatgtgaccgagggcatgcggaagcccgcgttcctgtccggcgagcagaagaaggccattgtggacctcctgttcaagaccaatcgcaaggtcacagtcaagcagctcaaggaggattacttcaagaagatcgagtgcttcgactcggttgagattagcggggtggaggatcggttcaacgcgagcctcggcacttaccacgacctcctgaagatcatcaaggataaggacttcctcgacaacgaggagaacgaggatattctggaggacatcgtgctcaccctgacgctgttcgaggatcgggagatgatcgaggagcgcctgaagacctacgctcatctcttcgatgataaggtcatgaagcagctgaagaggaggcggtacaccgggtggggccgcctgagcaggaagctcattaacgggatcagggacaagcagagcggcaagaccatcctggacttcctcaagagcgatggcttcgccaaccggaatttcatgcagctcatccacgacgactccctcaccttcaaggaggacattcagaaggctcaggtcagcggccagggcgactcgctgcatgagcacatcgctaacctggcgggcagcccagccatcaagaagggcatcctccagacagtgaaggtcgtggatgagctggtgaaggtcatgggccggcataagcccgagaatattgtgattgagatggcgcgggagaatcagaccactcagaagggccagaagaactcgcgggagcgcatgaagaggatcgaggaggggattaaggagctgggcagccagattctcaaggagcaccccgtggagaatacccagctccagaacgagaagctgtacctctactacctccagaatgggcgggacatgtatgttgatcaggagctggacatcaatcgcctctcggattacgacgtggaccacatcgtgccccagagcttcctgaaggatgatagcatcgacaataaggtcctgacccgctccgacaagaatcgcggcaagagcgacaacgtgccgagcgaggaggtcgtgaagaagatgaagaactactggcggcagctgctgaacgcgaagctcattacacagcggaagttcgataacctgacgaaggcggagaggggcggcctctccgagctggacaaggcgggcttcattaagaggcagctcgtggagactcgccagatcaccaagcacgtggctcagatcctcgatagccggatgaatacgaagtacgatgagaatgacaagctcatccgggaggtgaaggtaatcaccctgaagtcaaagctcgttagcgatttccggaaggacttccagttctacaaggtgcgggagattaacaactaccatcatgcgcacgatgcgtacctcaatgcggtggtgggcacagccctgattaagaagtaccccaagctggagagcgagttcgtctacggggactacaaggtgtacgatgttcggaagatgatcgccaagagcgagcaggagattgggaaggccaccgctaagtacttcttctactcgaatattatgaatttcttcaagaccgagatcacactcgctaatggggagattcggaagcggcccctcatcgagactaacggggagactggcgagattgtgtgggacaaggggcgcgacttcgctaccgtgcgcaaggtcctctcgatgccccaggttaatattgttaagaagacagaggtgcagacgggcgggttctccaaggagtctatcctgccgaagcggaactcggacaagctgatcgcccgcaagaaggattgggaccccaagaagtacgggggattcgatagcccaaccgtggcttacagcgtcctggtggtcgccaaggttgagaaggggaagtcgaagaagctcaagagcgttaaggagctgctgggcatcaccatcatggagcggtccagcttcgagaagaatcctatcgacttcctggaggctaaggggtacaaggaggtcaagaaggacctgatcattaagctgcccaagtactctctgttcgagctggagaacgggaggaagcggatgctggcgtctgctggcgagctacagaagggcaatgagctggcgctcccctcgaagtatgtcaacttcctctacctggcttcccattacgagaagctgaagggctcgcccgaggataatgagcagaagcagctcttcgtggagcagcacaagcactacctcgacgagatcattgagcagatttcggagttctcgaagcgggtcattctcgcggacgcgaacctcgacaaggtcctctcggcgtacaacaagcaccgggacaagcccatccgggagcaggccgagaacattatccacctcttcacactgaccaacctcggcgctcccgccgcgttcaagtacttcgacaccaccattgaccgcaagagatacacatccaccaaggaggtgctggacgcgaccctcatccaccagagcatcacaggcctctacgagacacggatcgacctctcgcagctcgggggcgat

SEQ ID NO: 63 - DNA, 4092 bp, Artificial sequence
  Synthetic polynucleotide
gacaagaagtactcgatcggcctggcgattggcacaaacagcgtggggtgggctgtgatcactgatgagtacaaggtgccatcgaagaagttcaaggtgctggggaatacagaccggcattcgatcaagaagaatctcattggcgctctcctcttcgattccggcgagactgctgaggcgacccgcctgaagcgcaccgcccggcggcgctacactcggcggaagaataggatttgctacctccaggagattttctcgaatgagatggccaaggtggatgacagcttcttccaccgcctggaggagtcgttcctggtcgaggaggacaagaagcatgagcggcaccctatcttcgggaatatcgttgatgaggtcgcctaccacgagaagtaccccactatctaccatctccgcaagaagctcgtggacagcacagataaggccgacctccgcctgatctacctcgccctcgcgcacatgattaagttccgggggcacttcctcattgagggggatctgaatcccgataactccgacgtggacaagctgttcatccagctggtgcagacatacaaccagctgttcgaggagaatcccatcaacgcgagcggcgtggacgctaaggccattctgtcggctaggctctcgaagtcgaggcggctggagaacctgattgcgcagctccccggcgagaagaagaacgggctgttcgggaatctcatcgccctctccctcggcctcacaccaaacttcaagagcaatttcgacctggctgaggacgctaagctgcaactctcaaaggatacatacgatgacgacctggacaatctcctggctcagatcggcgaccagtacgctgacctgttcctcgcggccaagaatctgtcggacgcgattctcctcagcgacatcctgcgcgtcaataccgagattacgaaggctccactgtctgcgtcaatgattaagcggtacgatgagcatcaccaggatctgaccctcctgaaggcgctcgtgcggcagcagctgcccgagaagtacaaggagattttcttcgatcagagcaagaatggctacgccggctacatcgacgggggcgcgagccaggaggagttctacaagttcatcaagcccatcctggagaagatggacggcaccgaggagctactcgtgaagctcaatcgggaggatctcctccggaagcagcggacattcgataacgggtctatcccacaccagatccacctcggcgagctgcatgcgattctgcggcggcaggaggatttctaccctttcctgaaggacaaccgggagaagatcgagaagatcctcacattccggattccatactacgtcggccccctggcgaggggcaatagccggttcgcgtggatgacaaggaagtccgaggagactattaccccgtggaatttcgaggaggtggttgacaagggcgcttccgcgcagagcttcattgagcggatgacaaacttcgacaagaatctccccaacgagaaggtcctgccgaagcatagcctcctgtacgagtacttcaccgtctacaatgagctaactaaggtcaagtatgtgacagagggcatgaggaagccagccttcctctcaggcgagcagaagaaggccattgtggacctcctgttcaagacaaaccgcaaggtgacagtgaagcagctgaaggaggattacttcaagaagattgagtgcttcgactcagtggagatttcaggcgtggaggatcggttcaacgcgagcctggggacttaccacgacctgctgaagattattaaggacaaggacttcctggataacgaggagaatgaggacatcctggaggatattgtgctcaccctcaccctgttcgaggacagggagatgattgaggagaggctcaagacctacgcgcacctgttcgatgacaaggtcatgaagcagctgaagaggcggcgctacactgggtggggccgcctgtcgcggaagctgatcaacggcattcgggataagcagtccgggaagaccattctggatttcctgaagtcggacggcttcgccaacaggaatttcatgcagctgatccacgacgactccctcaccttcaaggaggacattcagaaggcccaggttagcggccagggggactcactccacgagcatattgccaatctggccggctctccagctatcaagaagggcatcctgcaaacagttaaggttgttgacgagctggttaaggtcatggggcggcataagcccgagaacattgtcatcgagatggctcgggagaaccagacaactcagaagggccagaagaactccagggagcgcatgaagcggattgaggagggcattaaggagctggggtcccagatcctcaaggagcaccctgtcgagaacactcagctgcaaaacgagaagctctacctgtactacctccagaacgggcgggatatgtatgtggatcaggagctggacatcaacaggctctccgactacgacgtggatcacattgtcccacagtctttcctcaaggatgattccatcgacaacaaggtgctgacgcgcagcgacaagaatagggggaagtcggacaacgttccgagcgaggaggtcgtgaagaagatgaagaattactggaggcagctcctgaatgcgaagctgatcactcagaggaagttcgacaatctgacaaaggcggagaggggcgggctctcggagctggataaggcgggcttcatcaagcggcagctcgttgaaacccggcagatcaccaagcatgtcgcccagatcctcgatagccgcatgaacaccaagtacgatgagaacgacaagctcattcgggaggttaaggtcattacgctgaagtccaagctcgtcagcgacttcaggaaggatttccagttctacaaggttcgggagattaacaactaccaccacgcgcatgatgcgtacctgaacgctgttgtcggcactgctctcatcaagaagtacccaaagctggagtccgagttcgtctacggggactacaaggtctacgatgtccggaagatgatcgccaagtcggagcaggagatcgggaaggctactgcgaagtacttcttctacagcaacattatgaatttcttcaagacggagattacgctggcgaacggggagattaggaagaggcccctcattgagactaatggggagacaggcgagattgtttgggacaagggccgcgacttcgcgactgtgcggaaggtcctgtccatgccacaggtgaatattgttaagaagacagaggtgcagactgggggcttctcgaaggagagcattctcccaaagcggaacagcgataagctcatcgcgcgcaagaaggattgggaccctaagaagtacggcggcttcgattctcccactgtggcctactccgttctcgtggttgccaaggttgagaaggggaagtcgaagaagctgaagtcggtcaaggagctgctcgggattacaatcatggagcggagcagcttcgagaagaaccctattgatttcctggaggccaagggctacaaggaggttaagaaggatctcattatcaagctccctaagtactctctgttcgagctggagaatggccggaagaggatgctggcctcggctggcgagctacagaaggggaatgagctggccctcccgtcgaagtatgtgaatttcctgtacctcgcgtcgcactacgagaagctcaagggcagcccggaggataatgagcagaagcagctcttcgtggagcagcataagcactacctggacgagatcattgagcagatcagcgagttctcgaagcgggttattctggctgatgctaacctggacaaggttctgagcgcctacaataagcatcgcgacaagccgattcgcgagcaggcggagaatattatccacctgttcaccctcactaacctcggggctcccgcggccttcaagtacttcgataccacaatagataggaagcggtacacctcgacgaaggaggtcctcgacgccacactcatccatcagtcgattacaggcctgtacgagacacggattgacctctcgcagctg

SEQ ID NO: 64 - DNA, 4101 bp, Artificial sequence
  Synthetic polynucleotide
gacaagaagtattccataggcctggctatcggcaccaacagcgtgggctgggccgtcatcaccgacgagtacaaagtgccgagtaaaaagttcaaagtgctcggcaacaccgaccgccactccataaagaaaaacctgatcggggcgctcctgttcgacagcggcgagacggcggaggccacccgcttgaaacgcacggcccgacggcgctacacgcggcgcaagaaccggatctgttacctacaggagattttctctaacgagatggcgaaggtggacgactcgttctttcaccgcctcgaagagtccttcctcgtggaggaggacaagaaacacgagcgccacccgatcttcggcaacatcgtggacgaggtggcctaccacgagaagtacccgaccatctaccacctccggaagaaactcgtggacagcacggacaaggccgacctgaggctcatctacctcgccctggcgcacatgattaagttccggggccacttcctgatcgagggcgacctgaacccggacaacagcgacgtggacaagctgttcatccagctagtccagacctacaaccagcttttcgaggaaaaccccatcaacgccagcggggtggacgcgaaggcgatcctgtccgcccggctgagcaagtcccggcggctggagaacctcatcgcgcagttgcccggcgagaagaagaacgggctgttcgggaacctgatcgccctctccctggggctcaccccgaacttcaagtccaacttcgacctcgccgaggacgccaaactacagctgagcaaggacacctacgacgacgacctcgacaacctgctggcccagatcggggaccagtacgcagacctgttcctcgccgccaagaacctctccgacgccatcctgctgtcggacatcctgcgggtgaacacggagatcacgaaggccccgctctcggcctcgatgattaaacgctacgacgagcaccaccaggacttgaccctcctcaaggcgctggtccgccagcagcttcccgagaagtacaaggaaatctttttcgatcagagcaagaacgggtacgccgggtacatcgacggcggggcgtcccaggaggagttctacaagttcatcaagcccatcctggagaaaatggacgggaccgaggagctgctcgtgaagctcaaccgcgaagatttgctccgcaagcagcgcacgttcgacaacgggtcgatcccgcaccagatccacctgggcgagctgcacgcgatcctcaggcgtcaggaagacttctaccccttcctcaaggacaaccgcgagaagatagagaagattctgaccttcagaattccttattacgtgggcccgctggctcggggcaactcgcgcttcgcctggatgacgcgcaagtccgaggagaccatcaccccgtggaacttcgaggaggtggtggataagggtgcctcggcccagtccttcatcgagcggatgaccaacttcgacaagaacctgccgaacgagaaggtgctccccaagcacagcctgctctacgaatatttcacggtgtacaacgagctgacgaaggtcaagtacgtgaccgagggaatgaggaaacctgcattcctctccggggagcagaagaaagccatagtcgacctcctgttcaagaccaaccggaaggtcaccgtcaagcagctcaaggaggactacttcaagaagatcgagtgcttcgattcagtggagatcagcggcgtcgaggaccggttcaacgccagcctgggcacctaccacgacctgctcaagatcatcaaggacaaggacttcctcgacaacgaggagaacgaggacatcctggaggacatcgtgctgaccctgacgctcttcgaggaccgcgagatgatcgaggagcgcctcaagacctacgcccacctgttcgacgacaaggtgatgaagcagctcaagcggcggagatatactgggtggggccgcctctcccggaagctcattaacggtatcagggataagcagtccgggaagacgatcctcgacttcctcaagtcggacgggttcgccaaccgcaacttcatgcagctcatccacgacgactccctgacgttcaaggaggacatccagaaggcccaagtgtctggtcaaggtgactcgctccacgagcacatcgccaacctcgcgggcagcccggccatcaagaagggaatactccagaccgtcaaggtggtggacgagctggtgaaggtcatgggccgccacaagccggagaacatcgtcatcgagatggcgcgggagaaccagaccacgcagaaggggcagaaaaatagccgtgagcgcatgaagcgcatcgaggaggggattaaggagttgggcagccagatcctcaaggagcaccctgtggagaacacgcagttgcaaaacgagaagctctacctgtactacctccagaacgggagggatatgtacgtggaccaagaactggacatcaaccgcctgtccgactacgacgtggaccacatcgtgccgcagagcttcctcaaggacgacagcatcgacaacaaggtgctcacccggtccgacaagaatcggggcaagtccgacaacgtgcccagcgaggaggtcgtcaaaaagatgaaaaactactggcgacaactactgaacgccaagctcatcacccagcgcaagttcgacaacctcacaaaagccgagcgcggcgggttgagcgagctggacaaggccgggttcatcaagcgccagctcgtcgagacgcgccagatcacgaagcacgtcgcgcagatactcgacagccggatgaacaccaagtacgacgagaacgacaagctcatccgggaggtgaaggtcatcaccctcaagtcgaagctcgtgagcgacttccgcaaggacttccagttctacaaggtccgggagatcaacaactaccaccacgcccacgatgcttatcttaacgccgtggtggggacggccctcattaagaaatacccgaagctggagtcggagttcgtgtacggcgactacaaggtgtacgacgtcaggaagatgatcgccaagtccgaacaggagatcgggaaggccacggcgaaatacttcttctacagcaacatcatgaacttcttcaagaccgagatcaccctcgccaacggcgagatccgcaagcgcccgctcatcgagacgaacggggagaccggcgagatcgtctgggacaaggggcgcgacttcgccactgtgcggaaggtgctgtcgatgccccaggtcaacatcgtcaagaagacggaggtccagacgggcgggttcagcaaggagagcatcctgccgaagcgcaacagcgacaagctgatcgcccgcaaaaaggactgggatccaaaaaagtacggcggcttcgacagccccaccgtcgcctacagcgtcctcgtcgtcgctaaagtcgagaagggcaagtccaaaaagctcaagagcgtcaaggagctgctcgggatcaccatcatggagcggtccagcttcgagaagaacccaattgatttcctggaggcgaagggctacaaggaggtcaagaaagacctcatcataaagctgccgaagtactcactcttcgagctggagaacgggcgcaagcggatgctggcgtcggccggagagctccaaaagggcaacgagctggcgctgccgagcaagtacgtgaacttcctctacctggcgtcccactacgagaagctcaagggcagtccagaggataacgagcagaagcagctattcgtggagcagcacaagcactacctggacgagatcatcgagcagatcagcgagttctccaagcgcgtcatcctggcggacgccaacctggacaaggtgctgtccgcgtacaacaagcaccgcgacaagccgatccgcgagcaagccgagaacatcatccacctgttcaccctcacgaacctcggggcacccgccgccttcaaatatttcgacacgaccatcgaccgcaagcgctacaccagcacgaaggaggtgctcgacgccaccctgatccaccagagcatcaccgggctgtacgagacccgcatcgacctctcgcagctcggcggggac

SEQ ID NO: 65 - DNA, 4101 bp, Artificial sequence
  Synthetic polynucleotide
gacaagaagtacagtattggattggccatcgggacgaacagcgtgggctgggccgtcatcaccgacgagtacaaggtgccatccaagaagtttaaggttctggggaataccgaccgccactcgatcaagaaaaatctcatcggggcgctgcttttcgacagcggcgagacggcggaagcgacgcggctcaagcggacggctcgtcgccgttacacccggcgtaagaaccgcatctgttacctccaggagatattcagcaacgagatggcgaaggtggacgactcctttttccaccgtcttgaggagtccttcctggtcgaggaggacaagaagcacgagcgccacccgatcttcgggaacatcgtggacgaggtggcctaccacgagaagtaccccacgatctaccacctccgcaaaaaactcgtggactcaactgacaaggccgatttgaggcttatctacctcgccctcgcccacatgattaagttccgtgggcacttcctaatcgagggtgacctcaaccccgacaactctgacgtggacaagctgttcatccagcttgtgcagacctacaatcagctctttgaggagaatccgatcaacgcatctggtgtggacgcaaaggccatcctcagcgcgcggctgagcaagtctaggcggttggagaacctgatcgcccaactgcccggcgagaagaaaaatggcctcttcggcaacctgatcgccctgtcgctggggctcacgccgaacttcaagagtaactttgacctggcggaggacgctaagctccagctatctaaggacacatacgacgacgacctggacaacctgctggcccagatcggcgaccagtacgccgacctcttcctagccgccaagaacctgtccgacgccatcctcctcagcgacatcctgcgcgtgaacacggagatcacgaaggctccgctcagcgcctccatgattaagcggtacgacgagcaccaccaagacctaactttactcaaagccctcgtgcggcagcagcttcccgagaagtacaaagagatattttttgatcagtccaagaacggttatgcgggctacatcgacggcggcgcgagccaggaggagttctacaagttcatcaagcccatcctggagaagatggacggcacggaggagctgctcgtgaagctcaaccgtgaagacctcctgcgaaagcagcgaaccttcgacaacggttcgatcccgcaccagatccacctcggggagctgcacgccatcctgaggcgacaggaggacttctaccctttcctaaaggacaaccgcgagaagattgaaaaaatcctgacgtttcgcataccctactacgtcggcccgctggcgcgcggcaactcccggttcgcctggatgacccgtaagagcgaggagacgatcaccccgtggaacttcgaggaggtcgtggacaagggcgcgagcgcgcagagcttcatcgagcgcatgaccaacttcgacaagaacctcccgaacgagaaggtgctcccaaagcactccctcctgtacgagtatttcaccgtgtacaacgagttgacaaaggtgaagtacgtgacggagggaatgcggaagcctgcgttcctctcgggcgagcagaagaaggcaatcgtggacctgctcttcaagaccaaccggaaggtgacggtgaagcagctcaaggaggactacttcaaaaaaatcgagtgcttcgactccgtggagataagcggcgtggaggaccgattcaacgcctccctcggcacctaccacgacctccttaagatcatcaaggacaaggacttcctggacaacgaggagaacgaggacatcctggaggacatcgtgctcaccctgaccctcttcgaggaccgggagatgatcgaggagcgcctcaagacgtacgcccacttgttcgacgacaaggtgatgaagcagctcaagcggcggcgatacaccgggtggggccgcctatcccgcaaacttatcaacggcatccgcgacaagcagtccggcaagacgatcctggatttcctcaagtcggacgggttcgccaaccggaacttcatgcagctcatccacgacgacagcctcacgttcaaggaggacatccagaaggcccaagtgagcggtcaaggggacagcctccacgagcacattgcgaaccttgctgggagccctgcgatcaagaaggggatattgcaaaccgtgaaggtcgtggacgagttggtgaaggtcatggggcgacacaagcccgagaacatcgtgatcgagatggccagggaaaatcagaccacgcagaagggccaaaaaaacagccgcgagcggatgaagcggatcgaggagggcatcaaggagctggggtcgcagatcctcaaggagcacccggtggagaacacgcagctccagaacgagaagctgtacctctattacctacagaacgggcgggatatgtacgtggaccaggagctagacatcaaccgcctgtccgactacgacgtggaccatatcgtcccgcagtcgttcttgaaggacgacagcatcgacaacaaggtgctcacaagatcggataagaatcgaggcaagtccgacaacgtgccctcggaggaggtggtcaagaaaatgaaaaactactggcggcagttgctgaacgccaagctcattacgcagcggaagttcgacaacctgacgaaggctgaacgtggtgggctcagcgagctagacaaggcggggttcatcaagcggcagctcgtcgagacccggcagatcaccaagcacgtggcgcagatcctggactcgcgcatgaacaccaagtacgacgagaacgacaagctcatccgtgaggtgaaggtcatcacccttaagtctaagctggtcagtgacttccgcaaggacttccagttctacaaggtccgggagatcaacaactaccaccacgcgcacgacgcctacctcaacgcggtggtggggacggcgcttattaagaaatatcccaagctggaaagcgagttcgtttacggcgactacaaggtgtacgacgtccgcaagatgatcgcaaagtcggaacaggaaatcggaaaggcgacggccaaatatttcttttactccaacatcatgaatttttttaagacggagatcaccctggcgaacggggagatccgcaagcggcccctcatcgagaccaacggggagacgggcgagatcgtctgggacaagggccgggacttcgccaccgtgcggaaggtgctttctatgcctcaagtcaatatcgtcaaaaagacagaggtgcagaccggcgggttcagcaaggagtctatcctgccgaagcgcaactcggacaagctcatcgcgcgcaagaaagactgggaccccaaaaaatatggcgggttcgactcgccgaccgtcgcctacagcgtcctcgtggtggctaaggtcgagaagggcaagagcaaaaagctaaagtcggtgaaggagctgctgggcatcaccatcatggagcgctcgtctttcgagaagaatccaatcgacttcctagaggcgaaggggtacaaggaggtcaaaaaggatcttatcatcaaactgccgaagtacagtctgttcgagctggagaacgggcggaagcggatgctggctagtgcgggcgagttgcagaagggcaacgagttggcactgccctccaagtacgtgaacttcctgtacctggcctcccactacgagaagctcaaggggagccccgaggacaacgagcagaagcagctattcgtcgagcagcacaagcactacctggacgagatcatcgagcagatcagtgagttctccaagcgggtcatcctcgcggacgccaacctggacaaggtgctgagcgcgtacaacaagcacagggacaagccaatcagggaacaggccgagaacatcatccacctgttcaccctgaccaacctgggtgcaccggctgccttcaagtactttgacacgaccatcgaccggaagcgctacacctccacgaaggaggtgctggacgccacgctgatccaccagagcatcaccgggctctacgagacacggatcgacctgagccagcttggcggggac

SEQ ID NO: 66 - DNA, 4092 bp, Artificial sequence
  Synthetic polynucleotide
gacaaaaagtattccattggactcgctatcggcacgaacagcgtcgggtgggcggtcatcactgacgagtacaaggtgccgagcaagaagtttaaggtgctgggaaacaccgacaggcactcgatcaagaaaaatcttatcggggccctactcttcgactccggagaaaccgccgaggccacccggttgaagcgcacggcccgccgtcgctacaccaggcgcaagaaccggatctgctacctccaggagatattcagcaatgagatggcgaaggtggacgactcgttttttcacaggctagaggagtctttcctcgtggaggaggacaagaaacacgagcgccaccccatcttcggcaacatcgtggatgaggtggcatatcacgagaagtacccaaccatctaccacctccgcaaaaagctcgtggactctaccgacaaggccgacctccgtctgatctacctcgcgctggcccacatgattaagttccgaggacactttctgatcgagggcgacctgaacccagacaacagcgacgtggacaagctgttcatccaacttgtccagacctacaatcagctcttcgaggagaaccctatcaacgcctcgggcgtggacgcgaaggccatcctgtccgcccgcctgagcaagtcgcggcggctggagaacctgatcgcccagctccccggcgaaaaaaagaacggcctcttcggcaacctcatcgcgttgtcgctggggctcaccccgaacttcaagtccaacttcgacctggccgaggacgctaaactccagctctcgaaggatacctacgacgacgacctcgacaacctgctggcccagatcggcgaccagtacgcggaccttttcctggcggccaagaacctgagcgacgcgatcctccttagcgacatactccgtgtgaacaccgagatcacgaaggccccgctctccgcgtccatgattaagcgctacgacgagcaccaccaagaccttaccctgcttaaggcgctggtcaggcagcagttaccggagaagtacaaggagatcttttttgatcaatctaagaacggttacgccgggtacatcgacggcggcgcgtcccaggaggagttctacaagttcatcaagccgatcttggagaaaatggacgggaccgaggagctgctcgtgaagctcaaccgcgaagacctcctccgcaagcagcgcaccttcgacaacgggagcatcccgcaccagatccacctgggagagctgcacgcgatcctgcggagacaagaggacttctaccccttcctcaaggacaaccgggagaagattgaaaaaatacttacttttcgtatcccgtactacgtcgggccccttgcgaggggcaactccagattcgcgtggatgacccgcaagtccgaggagaccatcaccccgtggaacttcgaggaggtggtggacaagggcgcgtcggcccagtcgttcatcgagcgcatgaccaacttcgacaagaaccttccgaacgagaaggtgctcccgaagcacagcctgctctacgaatattttactgtgtacaacgagctgacgaaggtcaagtacgttacggaggggatgaggaagcccgccttcctctccggcgagcagaagaaagccattgtggatctcctgttcaagaccaaccgcaaggtgacggtgaaacagctcaaagaggactacttcaagaagatcgagtgcttcgactccgtagagatcagcggggtcgaggaccgcttcaacgcctcgctgggcacgtaccacgacctgctaaagattatcaaggacaaagacttcctagacaatgaggagaacgaggacattctggaggacatcgtgctgactctgacgctgttcgaagaccgcgagatgatcgaggagcggcttaagacgtacgcccacctgttcgacgacaaggtgatgaagcagttgaaacggcggcgctacaccgggtggggccgcctctcccgcaagctcatcaacggcatccgcgacaagcagtcggggaagacgatcctggacttcctcaagagcgacggcttcgccaaccgaaacttcatgcagctaatccacgacgacagcctgacgttcaaggaggacatccagaaggcccaagtgagcggccagggagactcgctacacgagcatatcgccaacctggctggcagcccggcgattaagaaaggaatcctccaaaccgtcaaagtggtggacgagctggtgaaggtgatgggccgccacaagcccgagaacattgtgatcgagatggcgcgggagaaccagacgacgcagaagggccaaaaaaatagcagggaaaggatgaagcgaatagaggaggggatcaaggagctggggagccagattctcaaagagcacccggtcgagaacacacagctccagaacgagaagctgtacctctactacctccaaaacggccgcgatatgtacgtggaccaggaactagacatcaaccggctgagcgactatgacgtggaccacatcgtgccgcagtccttcctcaaggacgactcgattgacaacaaagtgctcactagatccgacaagaacagaggcaagagcgataacgtcccgtcggaggaggtcgtcaagaaaatgaaaaactactggcggcagctcctaaacgccaagctcatcacgcagcgtaagttcgacaacctgacgaaggcggagcggggcgggctgagcgagctggacaaagcggggttcatcaagcggcagctcgttgagacgcggcagatcacaaagcacgtcgcgcaaatcctcgactcccgcatgaacaccaagtacgacgagaacgacaagctcatccgggaggtgaaggtcattacccttaaatcgaagctcgtcagcgactttcgtaaggacttccagttctacaaggtcagagagatcaacaactaccaccacgcccacgacgcctatctgaacgccgtggtgggcaccgcgcttattaagaagtaccccaagctggagtccgagttcgtgtacggcgactacaaggtttatgacgtcaggaagatgatcgccaagtcggaacaggagatcggaaaagctaccgccaaatatttcttctatagcaacatcatgaacttcttcaaaaccgagatcaccctcgccaacggcgagatccggaagcgcccgctcatcgagaccaacggggagaccggggagatcgtctgggacaaggggcgggacttcgctactgtccgaaaggtgctctccatgccacaagtgaatatcgtcaagaaaacagaggtgcagaccggagggttcagtaaggagtccatcctgcccaagcggaactccgacaagctaattgctcgcaaaaaggattgggatcctaaaaaatatggcggcttcgactcgcccacggtcgcctactctgtgctggtcgtggcgaaggtggagaagggcaagtccaagaagctcaagagcgtcaaggagctgctggggatcacgatcatggagcgtagttcgtttgagaagaatcccatcgacttcctggaggctaagggctacaaggaggtcaaaaaggacctcatcattaagctgccgaagtacagcctcttcgagctggagaacgggcggaagcgtatgctcgcctccgctggggagttacaaaaggggaacgagctggcgctgccgtctaagtacgtcaacttcctgtacctggcctcccactacgagaagctcaaggggtcgccggaggacaacgagcagaagcagctcttcgtagagcagcacaagcactacctggacgagatcatcgagcagatttcagagttctcaaagcgggtcatcctcgccgacgccaacctggacaaggtgctctcggcctacaacaagcaccgggacaagccgatccgcgaacaggccgaaaacatcatccacctgttcacgctcaccaacctcggtgccccggcggccttcaagtactttgacacgaccatcgaccggaagcgctatacctcgacgaaggaggtgctggacgccaccctgatccaccagtccatcaccgggctttacgagacccggatcgacctctcgcagcta

SEQ ID NO: 67 - DNA, 4101 bp, Artificial sequence
  Synthetic polynucleotide
gacaagaagtatagtattggactcgccatcggaaccaactctgtggggtgggctgttattacagatgaatataaggtgccatccaaaaagtttaaagttctgggcaatactgatagacactcaatcaagaagaatctgataggtgcacttctgtttgatagtggagagactgccgaggcaaccagacttaaaaggactgcaagaagaagatataccagaagaaagaataggatttgctatttgcaggaaatcttcagcaacgaaatggccaaggttgatgactcatttttccataggttggaggagagttttcttgtggaggaagataagaagcacgaaagacacccaattttcgggaatatagtggacgaggtggcttatcatgagaagtatcccactatctaccacctgagaaagaaacttgtggactcaaccgataaggctgatcttaggcttatatacttggcccttgcacatatgatcaaattcaggggccattttcttatcgaaggcgatcttaatcccgataactcagatgtggacaagctgtttatacaacttgtgcaaacctacaatcaactcttcgaggagaatcccattaacgcctccggcgtggatgcaaaagccatactgtcagccagactgagcaaaagtaggagactggagaatcttatagcccaactgcccggtgaaaagaagaatgggctcttcggaaatctgatcgctctttcattggggttgacacccaactttaagagtaactttgacttggcagaagatgcaaagttgcagctcagtaaagacacatatgacgatgaccttgacaatctcttggcacaaataggggatcaatacgctgaccttttcctcgctgccaagaacctcagcgacgctatactgttgtccgacattcttagggttaataccgaaattacaaaggcccctcttagtgcaagtatgatcaaaaggtatgatgagcatcaccaagaccttacactgctgaaggctctggttagacagcaactccctgaaaagtataaggaaatattcttcgaccaaagtaagaacgggtacgccggttatattgatgggggcgcaagtcaagaagaattttacaaattcatcaagccaattcttgaaaagatggacgggactgaggaattgctggtgaaactgaatagagaggaccttcttagaaaacagaggacatttgacaatgggtccatcccacaccagattcatctgggggaactccacgcaatattgaggagacaagaagacttttacccattccttaaggataatagagagaaaatcgaaaaaatcctgactttcaggattccttactatgttgggccactggccagggggaactcaagattcgcttggatgacaaggaagtcagaagaaaccataaccccttggaattttgaagaggtggttgataagggggcatcagcccagtctttcatagagaggatgaccaactttgataaaaatcttccaaatgagaaggttttgccaaaacatagtcttttgtacgagtactttactgtttataacgaattgaccaaggtgaagtatgtgaccgagggaatgaggaagccagcatttttgtccggggagcaaaagaaagcaatcgttgatcttctcttcaagaccaacagaaaagtgaccgtgaaacaactgaaggaagactacttcaaaaagatagaatgtttcgattcagtggaaattagcggtgttgaagacaggttcaatgcttcattgggtacttaccacgacctgttgaagataatcaaagacaaggactttctcgataatgaggagaacgaagacatcttggaagacattgtgcttacactcactttgtttgaggacagggaaatgattgaggaaagactcaaaacttacgctcatttgtttgatgataaggttatgaaacaactaaaaagaagaaggtacaccggctggggaagattgagtaggaaactgatcaacggtattagagataaacaatccggaaagactatcctcgatttccttaagagtgatggctttgcaaataggaattttatgcagctgattcatgacgactcacttaccttcaaagaagacatccaaaaagctcaggtgtctgggcaaggcgacagtctgcatgaacatatagctaacttggctgggagtcccgccatcaagaaggggatacttcaaacagttaaagttgtggacgaattggtgaaggtaatgggaaggcacaagcctgaaaatatagtgatagaaatggcaagggaaaatcaaacaacccagaagggacagaagaacagtagggaaaggatgaaaaggatagaagaggggatcaaagagcttggtagccagatcctcaaggaacatccagtggagaatacccaacttcaaaacgagaaactctatttgtactacttgcagaacggaagagatatgtatgtggaccaagagcttgatattaacaggctgagcgattatgacgttgaccacatagtgccccaatcattcctcaaggatgactctattgataataaggtgctgacaaggagtgacaagaatagagggaaatccgacaacgttccatccgaggaagttgtgaagaagatgaagaactactggaggcagttgctgaacgctaagctcattacccagaggaaattcgataacctgaccaaagcagagagaggcgggctgagcgaactcgataaagcaggtttcatcaagagacaactcgtggagactaggcaaattactaagcacgtggctcaaatactcgacagcaggatgaacacaaagtacgacgagaacgacaagctcattagagaggttaaggttattactctgaaaagtaaattggttagcgatttcagaaaggatttccaattctataaggttagagagatcaacaattatcatcatgcacatgatgcctatctgaatgctgtggttggtacagcccttatcaagaagtaccctaagctagagagcgagtttgtgtacggagattataaggtgtatgatgtgaggaaaatgatcgctaaaagtgagcaagagattggaaaggctaccgccaaatacttcttttattccaatattatgaatttcttcaagacagaaatcaccctggctaacggcgagataaggaagaggccgcttatcgaaactaatggggagacaggcgaaatagtgtgggacaaagggagggatttcgcaactgtgaggaaggttttgagcatgcctcaggtgaatatcgttaagaaaaccgaagttcaaactggagggttctctaaggaaagcattctccccaagaggaactccgacaagctgattgctagaaagaaagactgggaccccaagaagtatggcggattcgactcacccactgtggcatatagcgttctcgtggtggcaaaggttgaaaagggtaaatccaaaaaactcaaatccgtgaaggaactccttggcataactattatggaaaggagtagctttgaaaagaatcccatcgactttctcgaagctaagggctataaggaagttaagaaggaccttataatcaaacttccaaaatactccctttttgagttggaaaacggcagaaagagaatgttggccagtgccggggagcttcaaaagggcaacgaactggctctgcctagcaaatatgtgaactttttgtatctggcatcacactacgagaaacttaaaggctctcctgaggacaacgagcaaaaacagctctttgttgaacagcataagcactacctcgacgagattattgagcagatcagcgagttctcaaagagagttattctggctgacgctaatcttgacaaggttttgtccgcttacaacaaacacagggataagccaatcagggagcaggcagaaaacataatccatctctttaccctgacaaacctcggtgcccccgctgctttcaagtattttgatactaccattgacaggaagagatatacttccactaaggaagtgctcgacgcaaccctcatacaccaaagtatcacaggcctctatgaaactaggatagatttgtctcaacttgggggcgat

SEQ ID NO: 68 - DNA, 4101 bp, Artificial sequence
  Synthetic polynucleotide
gacaaaaagtattccatcgggcttgctatcggaaccaactctgtggggtgggcagttattaccgacgaatacaaggtgcccagcaagaagtttaaggttctggggaacacagatagacatagcataaagaaaaacctgataggcgcactgttgttcgactccggggaaacagccgaagctaccaggctgaagagaactgcaagaagaaggtacaccagaagaaaaaacagaatatgttatctccaagagattttctctaacgagatggccaaggtggacgactcattctttcacagactggaagaatctttccttgtggaagaagataagaaacacgagaggcaccctatttttggcaatatcgtggatgaggtggcttaccacgaaaaataccctacaatataccacctcaggaaaaaattggttgatagtacagacaaggccgacctcaggctcatctatttggccctggcccatatgattaaattcagggggcactttctcatcgagggagatttgaaccccgacaacagtgatgttgataagctctttattcagctcgtgcagacttacaatcagttgtttgaggaaaaccccattaatgcttccggggtggacgccaaggcaatcctttctgcaagactctcaaagtcaaggagactcgaaaatctgatagcacagcttccaggagagaagaagaacgggctctttggaaacctgatcgctctgtcactcggactcacacccaatttcaaaagcaattttgatttggcagaggacgctaagctgcaactcagtaaggatacctacgacgatgacttggataatctgctcgcacaaattggggaccagtatgcagacctgtttctcgcagctaagaacttgagtgacgccatattgctcagtgacatcctcagggttaataccgagattacaaaagctccactctctgcaagcatgatcaagaggtatgacgagcaccatcaagacctgacactccttaaggcgttggttaggcagcaacttcctgaaaagtataaggaaatcttcttcgatcaaagcaaaaacggctacgccggctatatagacgggggagcatcccaagaagaattttataagttcataaaacctatattggagaagatggacgggacagaggaattgctcgtgaaactgaacagggaggatctcctcaggaagcaaaggaccttcgacaatggctccatcccacatcagattcacctcggcgaactgcacgcaatactgagaagacaagaggacttttatcctttcctgaaggacaacagggagaaaatcgagaaaatcttgacattcagaatcccatactacgttgggcctctggccagaggtaacagtaggttcgcctggatgactaggaaatcagaggagactattacaccctggaactttgaagaagttgttgataagggagcttcagcacaatcattcatcgaaagaatgacaaactttgacaaaaatctgcctaatgagaaagtgctcccaaaacattccctgctgtatgagtattttaccgtttataacgagcttaccaaggtgaaatacgttactgaaggtatgagaaagccagcttttctttcaggggagcaaaagaaggctatcgtggatcttctctttaagaccaacagaaaggttaccgtgaagcagcttaaggaagactactttaaaaagatcgagtgttttgactcagtggaaataagcggtgttgaagatagattcaacgcatccttgggaacttatcatgatcttcttaagataatcaaggataaagactttctcgacaacgaggaaaacgaagatatactggaggacatagttctgacacttactttgttcgaggatagggagatgatcgaggaaagactgaaaacatatgctcaccttttcgacgacaaagttatgaaacaactcaagagaaggagatatacagggtgggggagattgagcaggaaactgattaatggtatcagagacaaacagtcaggaaaaacaatactcgactttttgaaatcagacgggttcgcaaataggaatttcatgcagcttatacacgacgattcacttacttttaaagaggacattcaaaaggctcaagttagtggacaaggtgactccctccacgaacacatcgcaaatctcgctggcagccctgcaattaagaagggtatactccagacagttaaggttgttgacgagctggttaaagtgatgggaagacacaaacccgagaacatagtgatagagatggccagggaaaaccaaaccactcaaaaagggcagaaaaattccagagagaggatgaaaaggattgaagaaggtatcaaggagctgggtagccaaattctgaaagaacatcctgtggaaaacactcaactccagaatgagaaactctatctgtactatctgcaaaatgggagagatatgtatgtggaccaggaactggacataaacaggctctcagattacgatgtggatcatatcgtgccacagtcctttcttaaggatgatagcatcgacaataaggtgcttaccaggtccgacaagaacaggggaaagtcagataacgtgccttctgaagaagttgttaaaaagatgaagaactactggagacagctgcttaacgctaagctcataacacagaggaagtttgacaacttgaccaaggccgagagaggcggactctcagaattggataaggcagggttcataaaaaggcagctggtggaaacaaggcagataactaaacatgtggctcagatcctcgatagtaggatgaatacaaaatacgatgagaacgacaagctcataagggaggttaaagtgataactctgaaatccaaactggttagcgattttaggaaggatttccagttttacaaagttagggagatcaacaattatcatcacgcccacgatgcctacttgaacgcagttgtgggtactgcacttatcaaaaagtaccctaagctggaatccgagtttgtttatggagactataaggtgtacgacgttagaaaaatgattgcaaagtcagagcaggagatagggaaagccactgcaaaatatttcttttatagcaatatcatgaatttctttaagacagaaatcacactggccaatggggaaataaggaagaggcccctgatcgaaactaatggcgagacaggggagattgtgtgggataaaggtagggactttgcaacagtgaggaaagtgctgagcatgccccaagttaatatcgttaaaaagaccgaggttcaaacagggggctttagtaaggaaagcattttgcccaagaggaatagtgacaaattgattgctaggaaaaaagattgggaccccaaaaagtatggcggatttgatagccccactgttgcttactccgtgctcgtggttgcaaaggtggagaagggaaagagcaagaaactgaagtcagttaaggaactccttggtatcactatcatggaaagaagctcctttgagaagaaccctattgacttcctggaggctaaagggtacaaagaggttaagaaagaccttatcattaaattgcccaaatatagtcttttcgagcttgaaaacggaagaaagaggatgcttgcatccgctggcgaattgcaaaagggcaatgagcttgctctcccttccaagtatgtgaacttcctttatcttgcctcacactatgaaaaactcaaaggttcacccgaagacaacgaacaaaagcaactatttgtggaacaacacaagcactacctggacgaaatcattgagcaaatttctgagttttcaaaaagggtaatcttggctgacgcaaatctcgacaaagttttgtcagcttacaacaaacatagagataagccaattagagagcaagctgagaatatcatccatctgtttaccctgactaaccttggagcgcctgctgcttttaaatatttcgacaccacaatcgacaggaagaggtacactagcactaaggaagttctcgacgccaccctcatccaccagagtattacaggcctgtacgagacaagaattgatctttctcaacttggtggtgac

SEQ ID NO: 69 - DNA, 4101 bp, Artificial sequence
  Synthetic polynucleotide
gataagaagtactcaatcggtctggcaatcggaaccaactctgtgggttgggcagtgattacagatgagtataaggtgccaagcaaaaaattcaaggtgctgggtaataccgacagacacagcattaagaagaatttgattggagcactcctctttgactcaggggaaacagcagaggcaacaaggctgaagaggacagcaaggcggaggtacacaaggcggaaaaacaggatatgctacctccaggaaatctttagcaacgagatggctaaagtggatgatagctttttccatagactcgaagaatcctttcttgttgaagaggacaaaaagcatgaaaggcatcccatcttcggcaatatagttgatgaggttgcataccatgagaagtaccccacaatctaccacctcagaaagaaacttgtggactccacagataaagcagacctgaggctcatatacctcgcactcgcacacatgatcaagttcagagggcactttctcatcgaaggtgacctgaatccagataattcagatgtggataaactgtttatacagctggtgcaaacatacaaccaacttttcgaggaaaacccaatcaatgcctccggtgttgatgcaaaggccatcctgtcagcaagactcagcaaaagcaggcggctcgaaaacctcatcgcccagcttcccggtgaaaagaagaacgggctctttggtaatctcatcgcattgagccttggtcttactccaaacttcaagagcaattttgatctggcagaggatgctaaactgcaactctcaaaggacacatatgacgatgaccttgacaatctgttggcccagatcggggaccaatatgcagacctcttcctggccgcaaagaatctgtcagatgcaatcctcttgtccgacatactgagagttaacactgagatcacaaaggcacctctgtccgcctccatgattaagagatacgatgagcatcaccaggatctgactttgctcaaagccctcgttagacagcagttgccagaaaagtacaaagaaatattctttgatcaatcaaaaaacggatatgcagggtacatcgacggtggggcaagccaggaagagttctacaaattcatcaaacctatcctggaaaagatggatgggacagaagagctgctggttaagctgaatagggaagacctcctcagaaagcagaggacatttgataacgggagcatccctcatcaaatccacctcggtgaactccatgctatcctgagaaggcaggaagacttttatccatttttgaaggacaatagggagaaaatcgaaaaaatcctgacattcagaatcccatactacgttggtcctctggcaagaggtaacagtaggttcgcatggatgacaaggaaaagcgaggagacaatcacaccctggaattttgaggaagttgttgacaagggtgccagcgcacaatcctttatcgaaagaatgacaaatttcgacaagaatctgcctaacgaaaaggttctcccaaagcattcactcctgtacgaatattttacagtttataacgaactgactaaagttaaatacgttaccgagggtatgaggaagccagcattcctttccggggaacagaagaaagctattgtggacctcctgttcaagacaaatagaaaagtgacagttaagcaactcaaagaggattacttcaaaaagatcgaatgttttgactctgtggagatcagcggggtggaggatagattcaacgccagcctgggtacatatcatgatctcctgaaaatcattaaagacaaggacttccttgacaacgaggagaacgaggacattctggaagacattgttctgaccctcacactctttgaggatagggagatgattgaggaaagactgaagacctacgcccacctctttgacgataaagtgatgaaacagctcaagagaagaaggtatacaggttgggggagactgagcaggaagttgatcaatgggattagggacaaacagtccgggaaaacaatcctcgattttctgaagtcagacggtttcgcaaacagaaattttatgcagctcattcacgatgacagcttgacattcaaggaagacatccaaaaggctcaagtgagcggccaaggggatagcctccacgagcatattgcaaatctggcaggttcaccagccatcaaaaagggcatacttcagacagttaaggttgtggacgaattggttaaagttatgggcaggcataagccagagaatatcgttatcgaaatggcaagggagaaccaaacaactcaaaaagggcagaaaaatagcagagagaggatgaaaagaatcgaggaagggatcaaggaacttgggtcccaaatcctcaaggagcacccagttgaaaatactcaactgcaaaacgagaagctctatctctactatctccaaaacgggagggatatgtatgttgaccaggagctggatattaacagactgtcagattatgatgttgatcatatcgtgccccagtcattcctgaaggacgattccatcgacaacaaagttctcacaaggtccgataaaaacaggggcaagtccgataacgttccaagcgaagaagtggtgaaaaagatgaaaaactattggagacaacttctgaatgcaaagttgattactcagagaaagtttgacaacctcacaaaagcagaaagaggcgggcttagcgaactcgataaggcagggtttatcaaaagacagctggttgagacaaggcagatcacaaaacatgtggcacagatccttgactcaaggatgaataccaagtatgatgagaatgataagttgatcagggaggttaaagttatcacactcaaatccaaactggtgtcagacttcaggaaagactttcaattttataaggtgagggagatcaataactaccaccatgcacatgacgcctacctgaacgcagtggtgggtacagcattgattaaaaaataccctaagctggagtctgagtttgtgtacggggactacaaggtgtacgacgtgaggaaaatgatagccaagtccgagcaggagatcgggaaagcaacagctaagtatttcttttacagtaatatcatgaatttctttaaaactgagattactctggcaaacggggagatcaggaaaagacccctcatcgagactaatggtgaaacaggtgagatcgtttgggacaaggggagggattttgctactgttagaaaagttctgagtatgccacaagtgaatattgtgaaaaagacagaagttcagacaggtgggttctccaaagaatccatcctgcccaagagaaattcagacaagctcatcgcaagaaagaaggactgggaccctaagaagtacggaggatttgacagccccaccgtggcctattccgtgcttgttgtggcaaaggtggagaaagggaagagcaaaaaactgaaatccgtgaaagaactgctgggaattaccatcatggaaagaagctcctttgagaagaacccaatcgacttcctggaagcaaaaggatataaggaagtgaaaaaggacctcattatcaagctcccaaaatactcacttttcgagttggagaacggtagaaagaggatgctggcaagcgcaggggaacttcagaaaggcaatgagctggcattgccatcaaagtatgtgaacttcctctacttggccagccattacgagaaacttaaaggtagcccagaagataacgagcaaaaacagctctttgtggaacagcataagcattatctggatgagatcatagaacaaatctcagagttttccaagagagttatcctcgcagatgcaaacctggataaggttctctcagcctataataagcatagagacaagccaattagagagcaagcagagaacattatccacttgttcactcttacaaacctgggggcaccagccgccttcaaatatttcgatacaacaatagacagaaagaggtataccagcaccaaagaagttctcgacgccacactgatccatcaatcaatcacaggcctttacgaaactaggatcgacttgtcacaactgggtggggat

SEQ ID NO: 70 - DNA, 3307 bp, Artificial sequence
  Synthetic polynucleotide
gagcaaggacacctacgacgacgacttggacaacctattggcccagataggtgaccagtatgcagacctcttccttgcggccaagaacttgagtgacgctatactgctcagtgacatcctgagggtgaacactgagatcactaaggcccctctctctgcctcaatgattaagcgttacgacgagcatcaccaggatctcaccctgcttaaggcccttgttcggcagcagctccctgagaagtacaaggagatattttttgaccagtctaagaacggctacgccggttacattgacggtggggcaagccaggaggagttctacaagttcatcaagccgatccttgagaagatggacggcaccgaggagctacttgtcaagttgaaccgggaagacctgctccggaaacagcgtacattcgacaacggcagcatccctcaccagatccacctgggcgaactacacgccatcctccgacgtcaggaggacttctatccattcttgaaagataacagggaaaaaatcgaaaaaatacttacgtttcgaataccttactacgtggggccccttgctcggggaaactccagattcgcatggatgaccaggaagtcagaggagaccatcacaccctggaactttgaggaggtggttgacaaaggtgcttctgcccagtccttcattgagcggatgactaacttcgacaagaacctgcccaacgagaaggtgctgccaaagcacagcctgctctacgaatactttactgtgtacaatgagctgacgaaggtgaagtacgtgacagaggggatgcggaagcccgctttcctgagcggcgagcaaaaaaaagcaatcgtggacctactgttcaagaccaaccgaaaggtgacagtgaagcagctcaaggaggactacttcaaaaaaatcgagtgcttcgactctgttgagataagcggcgtggaggaccgattcaacgcctcattgggaacctatcacgacctgctcaagatcattaaggacaaggacttcctggataatgaggagaatgaggacatcctggaggatattgtgctgacccttactctattcgaggacagggagatgatcgaggagcgactcaagacctacgctcacctgttcgacgacaaggttatgaagcaattgaagcgtaggcgatacacggggtggggaagactctcccgaaaactgataaacggcatcagggacaagcagtcagggaagacgatcttggacttcctgaaatccgacgggttcgccaaccgcaacttcatgcagctcattcacgacgactcactaacgttcaaagaggacattcagaaggctcaagtcagtggacaaggcgactccctgcacgagcacattgcaaaccttgcgggctccccggcgattaaaaagggcattctccaaacggttaaggtggtggacgagctggtgaaggtgatgggccgacacaagcctgagaacatcgtgatcgagatggccagggagaaccagactacccagaagggtcagaagaactctcgggaacgtatgaagcgtattgaggaggggattaaggagttgggctctcaaatcctcaaggagcaccctgtggagaacactcagctccaaaacgagaagctgtacctgtactacctgcaaaacgggcgcgatatgtacgtggatcaggagttggacatcaacaggcttagcgattacgacgtggaccacatcgtgccacagtcattcttaaaggacgacagcatcgacaacaaggttctgacgaggagcgacaagaatcgagggaaaagtgacaatgttccatccgaggaggtggtcaagaaaatgaagaactattggcgtcagcttctgaacgccaagctcatcacccagcggaaattcgacaacctgactaaggctgagcgaggcggactctccgagcttgacaaggctggcttcatcaagcggcagttggtcgaaacccgacagataacgaagcacgttgcccagatacttgactcccgtatgaacaccaagtacgacgagaacgacaagctcatcagggaggtgaaggtcattacccttaagtccaaactcgtcagcgactttcgtaaggacttccagttctacaaggtgcgcgagatcaataactaccaccacgcacacgacgcctacctgaacgcagtggttggaaccgcgttgattaaaaagtaccccaagttggagtcggagttcgtttacggggactacaaggtgtacgacgttcggaagatgatcgccaagtctgaacaggagatcgggaaagcaaccgccaagtatttcttctatagcaacatcatgaacttctttaaaaccgagatcacacttgccaatggcgagatccgtaagaggccgctgatcgagacaaatggggagactggcgagatcgtgtgggacaagggccgcgacttcgcaaccgttcggaaagtcttgtccatgcctcaagtcaacatcgtcaagaagactgaggtgcaaacaggcgggttctcgaaggagtccatactgcccaagaggaactcagacaagctcatagcacgcaaaaaagactgggatccaaagaaatacggcgggttcgactcgccgacagtcgcatactccgtgttagtggtggctaaagtggaaaaggggaagtccaagaagctcaagtccgtcaaggagttgctcgggatcaccattatggaacggtcctcattcgagaagaatcccattgacttcctagaggcgaagggctacaaagaggtcaaaaaggacctaattattaagctccccaagtattcactcttcgaacttgaaaatggtcgtaagcggatgttggcaagcgctggagagcttcagaaggggaacgagcttgcactgccttccaagtacgtgaacttcctgtacctcgcctctcattacgagaagttgaagggctcaccggaggacaacgagcagaagcagttgttcgtggagcagcacaagcactacctcgacgagatcattgagcagataagtgagttcagcaaacgggtgatccttgccgacgctaacctggacaaggtgctgagcgcctacaacaagcacagagacaagccgatccgagagcaagcggagaacatcatacacctgttcaccctcacgaacctcggggctcccgcagccttcaaatattttgacacgaccatcgaccgtaaacgctacactagcacgaaggaggtgctggacgctacccttatccaccagtccatcaccggcctgtacgagacgagaatcgacttgtcgcagctcggtggtgac

SEQ ID NO: 71 - DNA, 4101 bp, Artificial sequence
  Synthetic polynucleotide
gacaaaaaatactcaattggtctggcaattgggaccaacagtgtcggatgggccgtgattaccgacgagtacaaggtgccgtccaaaaaattcaaggtgcttgggaacaccgaccgccactcgatcaagaaaaacctaatcggtgcgttgcttttcgacagtggggagaccgccgaggcaacacgcttaaaacgcacagctaggaggagatatacacggcgcaagaaccgaatatgctacttacaggagatattctccaatgagatggcgaaggtggacgactctttcttccatcggcttgaggaatccttcctggtcgaggaggacaagaagcacgagcgacacccgatattcgggaacatcgttgatgaggtggcgtaccacgagaagtacccaacgatataccacttacgcaagaagctcgtggactctacggacaaggccgacttgcgccttatctacttggcactggcccacatgattaagttccgaggccacttccttatcgagggtgacctgaaccccgataactccgacgtggacaagctcttcatccaactcgtccagacatacaaccagctattcgaggagaatcctatcaacgcctctggggtggacgctaaagctatcctctcagcccgcctgtcaaagtcgaggaggttggagaacctaatcgcccagcttccaggcgagaagaaaaatgggctgttcggaaaccttatcgcactctcactgggcctaaccccgaacttcaagtccaacttcgacctggcagaggacgcgaaattgcagttgtcgaaagacacctatgacgatgacctggacaacctgttggcccagataggggaccagtacgccgacctgttcctagcggccaagaacctgtccgacgccatcttgctgtcggatatactgcgggtgaacaccgagatcactaaagcacctctctccgccagcatgattaagcgttacgacgagcaccaccaagatttgaccctgctaaaggcacttgtacggcagcagcttcccgagaagtacaaggagatctttttcgaccaaagcaagaacggctacgccgggtacatcgacggaggtgccagccaggaggagttctacaagttcattaagcccatcctggagaagatggacgggactgaggaactacttgtgaagctgaaccgggaagacttactacggaagcagcgtaccttcgacaacggttctatcccacatcagatccatcttggggagttgcacgcgatcctgcgacgccaggaggacttttaccccttcctgaaagacaaccgcgagaaaatcgagaagatactgaccttcagaataccttactacgtcggaccccttgcgcgaggcaactcaagattcgcgtggatgaccaggaaatcagaggagaccatcacaccctggaatttcgaggaggtggttgacaagggtgcctccgcccagtcctttatcgaacgaatgaccaacttcgacaagaacttgcccaacgagaaggtgctccccaaacacagcctcctctacgaatatttcacagtgtacaacgagcttactaaagttaagtatgttactgagggcatgaggaaacccgccttcctgtcaggcgagcagaagaaagctattgtggacctccttttcaagaccaaccggaaggtgacagtgaagcagctcaaggaggactacttcaagaagatagagtgcttcgacagcgtggagatcagcggggtggaggacagattcaatgcctctctcggaacataccacgacttgcttaagatcatcaaggacaaggacttcctcgacaacgaggaaaacgaggatattctggaggatattgttctgactcttaccctgttcgaggaccgggagatgatcgaggagcgtctcaagacctacgcccacctgttcgacgacaaagttatgaagcagctcaagcgtcggagatataccggatggggccgtctgtctcggaagctcatcaacgggatcagggacaagcagtcagggaagacgatcttagacttccttaagtctgacggcttcgccaacaggaacttcatgcagttgatccacgacgacagccttaccttcaaggaggacatccagaaggcccaagtgagtggccagggtgacagcctccacgagcatattgctaatcttgcgggttccccagcgattaaaaagggcatacttcaaaccgttaaggtggtggacgagcttgtcaaggtgatggggcgacacaagcccgagaacatcgtgatcgagatggccagggagaaccagaccacccagaaggggcagaagaatagccgagaacgcatgaagcgcatcgaggaggggattaaggagctagggagccagatcctcaaggaacatcccgtcgagaacacccagctccagaacgagaagctatacctctactacttgcaaaacgggagggatatgtacgtggatcaggagttggacattaaccgcctaagcgactacgacgtagatcacatcgtgcctcagtcattcctcaaagacgacagcattgacaacaaagtcttgacccgatccgacaagaaccgaggaaaatccgacaatgtgccctcagaggaggtcgtcaagaaaatgaagaactattggaggcagctacttaacgccaaactcataacccagcggaagttcgacaacctgacaaaggctgagcggggtgggctcagcgagcttgacaaggctggcttcatcaagcggcagttggtggagacaagacagataacgaagcacgtggctcagatcctggactctcgcatgaacacgaagtacgacgagaacgacaaattgatccgcgaggtcaaggttattacgctcaagagcaaacttgtcagcgatttccgcaaggacttccagttctacaaggtgagggagattaacaactaccaccatgcacatgatgcctacttgaacgcagtggtggggaccgcgcttattaaaaagtaccctaagttggagtcagagttcgtttatggggactacaaggtgtacgacgtccggaagatgattgcaaagtctgaacaggaaatcgggaaggccaccgccaaatatttcttctacagtaacattatgaatttttttaagactgaaattactctcgcaaacggcgagatcaggaagcgtcccctcatcgagacaaacggggagaccggggagatagtctgggacaaggggcgggacttcgctacggtgaggaaggtgctctcgatgccacaagtgaacatcgtcaaaaagacagaggtgcagaccggtggcttctcaaaggagtcaatcctgccaaaacgtaacagcgacaagctcatcgcccgcaagaaagactgggaccctaagaagtatggtgggttcgactcaccgacggtcgcatactccgttctggtcgtggcaaaggtggaaaagggcaagtccaaaaaactgaaatccgtgaaggagttgcttggcattaccatcatggaacgcagcagcttcgagaagaaccccattgacttcctggaggctaaagggtacaaggaggtcaagaaagatttaattattaagctacctaagtacagcttgttcgagctggagaacggccgaaaacgaatgctcgcatccgccggggaacttcaaaagggcaacgagcttgcgctgccctccaagtacgtgaacttcctgtacttggcatcccactacgagaaactcaagggtagcccagaggacaacgagcagaagcagctattcgtggagcagcacaagcactacctcgacgagataatcgagcagatcagtgagttcagtaagcgggtgatactcgcggacgccaacttggacaaggtgcttagtgcctacaacaagcaccgtgacaagcccatccgagaacaggctgagaacatcatccaccttttcactctgacaaacctcggtgctcccgccgccttcaaatacttcgacactaccatcgacaggaagcgctacacatctacgaaggaagttcttgacgctacgcttattcatcagtctatcacagggctgtacgagacaaggatcgaccttagccaactcggcggggat

SEQ ID NO: 72 - protein, 256 aa, Cucumis sativus
MRVLTGNSSPLLVPSSNPYHDSSSLFPCKRKSKKKNHGMVPMARLFGPAIFEASKLKVLFLGVDEKKHPGKFPRTYTLTHSDITSKLTLAISQSINNSQLQGWYNWLQRDEVVGEWKKVKGKMSLHVHCHISGGHFLLDLCANLRYFIFRKELPVVLNAFVHGDVDLFNNYPELQEAMVWVYFHSKIPEFNKVECWGPLKDPAPPSTGLDGSTQSQPMWELGLLERPKPCQEDCTCCFPTIPSISWSPKNNELEST

SEQ ID NO: 73 - protein, 261 aa, Glycine max
MCTLTTVPVLPSKLNKPSLSPHHNSLFPYCGRRVGKKNKAMVPVARLFGPAIFEASKLKVLFLGVDENKHPGNLPRTYTLTHSDITAKLTLAISQTINNSQLQGWYNRFQRDEVVAQWKKVKGRMSLHVHCHISGGHFLLDILARLRYFIFCKELPVVLKAVVHGDENLFNSYPELQDALVWVYFHSNIPEFNKVECWGPLKEASAPTGGVQEEGLAIPQPCQEECQCCFPPLTLSPIQWSKQVPSRHYEPCDGIGTQQNL

SEQ ID NO: 74 - protein, 271 aa, Glycine max
MGTLTTVPVLPSKLNKPSLSPRHNSLFPYYGRRVGKKNKAMVPVARLFGPAIFEASKLKVLFLGVDENKHPGNLPRTYTLTHSDITAKLTLAISQTINNSQLQGWYNRLQRDEVVAQWKKVKGKMSLHVHCHISGGHFLLDILARLRYFIFCKELPVVLKAVVHGDENLFNNYPELQDALVWVYFHSNIPEFNKVECWGPLKEASAPIGGAKEESEQETLLSKEGLAIPQPCQEECECCFPPLTLSPIQWSQQVPSHHYEPCDGIETQQSL

SEQ ID NO: 75 - DNA, 2298 bp, Glycine max
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaac

SEQ ID NO: 76 - DNA, 2216 bp, Glycine max
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaac

SEQ ID NO: 77 - DNA, 2253 bp, Glycine max
tcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctc

SEQ ID NO: 78 - DNA, 2251 bp, Glycine max
acacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttagg

SEQ ID NO: 79 - DNA, 1756 bp, Glycine max
atgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataa

SEQ ID NO: 80 - DNA, 1673 bp, Glycine max
atgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataa

SEQ ID NO: 81 - DNA, 786 bp, Glycine max
atgtgtactctcacaactgttcctgtgctcccttctaagcttaacaagccttcgctttctccgcaccacaattctctttttccctactgtggaagacgggtcgggaagaagaacaaagcaatggttcctgttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataa

SEQ ID NO: 82 - DNA, 816 bp, Glycine max
atgggtactctaacaactgttcctgtgctcccttctaagcttaacaagccttcgctttctccgcgtcacaattctctttttccctactacggaagacgcgtcgggaagaagaacaaagcaatggttcctgttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataa

SEQ ID NO: 83 - protein, 141 aa, Glycine max
GRRVGKKNKAMVPVARLFGPAIFEASKLKVLFLGVDENKHPGNLPRTYTLTHSDITAKLTLAISQTINNSQLQGWYNRLQRDEVVAQWKKVKGKMSLHVHCHISGGHFLLDILARLRYFIFCKELPVVLKAVVHGDENLFN

SEQ ID NO: 84 - protein, 111 aa, Glycine max
GRRVGKKNKAMVPVARLFGPAIFEASKLKVLFLGVDENKHPGNLPRTYTLTHSDITAKLTLAISQTINNSQLQGWYNRFQRDEVVAQWKKVKGRMSLHVHCHISGGHFLLD

SEQ ID NO: 85 - protein, 93 aa, Glycine max
GRRVGKKNKAMVPVARLFGPAIFEASKLKVLFLGVDENKHPGNLPRTYTLTHSDITAKLTLAISQTINNSQLQGWYNRFQRDEVVAQWKKVKG

SEQ ID NO: 86 - protein, 97 aa, Glycine max
ARLFGPAIFEASKLKVLFLGVDENKHPGNLPRTYTLTHSDITAKLTLAISQTINNSQLQGWYNRFQRDEVVAQWKKVKGRMSLHVHCHISGGHFLLD

SEQ ID NO: 87 - protein, 79 aa, Glycine max
ARLFGPAIFEASKLKVLFLGVDENKHPGNLPRTYTLTHSDITAKLTLAISQTINNSQLQGWYNRFQRDEVVAQWKKVKG

SEQ ID NO: 88 - protein, 41 aa, Glycine max
TLAISQTINNSQLQGWYNRFQRDEVVAQWKKVKGRMSLHVH

SEQ ID NO: 89 - protein, 21 aa, Glycine max
SQLQGWYNRFQRDEVVAQWKK

SEQ ID NO: 90 - DNA, 23 bp, Artificial sequence
  Synthetic oligonucleotide
ttgtgcattattattatgccatt

SEQ ID NO: 91 - DNA, 23 bp, Artificial sequence
  Synthetic oligonucleotide
agtcgtagccttggttgtgttgt

SEQ ID NO: 92 - DNA, 23 bp, Artificial sequence
  Synthetic oligonucleotide
gaagaaagtcatcacatatcttg

SEQ ID NO: 93 - DNA, 23 bp, Artificial sequence
  Synthetic oligonucleotide
gaagaaagtcattacgtatcttg

SEQ ID NO: 94 - DNA, 23 bp, Artificial sequence
  Synthetic oligonucleotide
ttctacaattttgactacattca

SEQ ID NO: 95 - DNA, 23 bp, Artificial sequence
  Synthetic oligonucleotide
ttctacaattttgactactttca

SEQ ID NO: 96 - DNA, 23 bp, Artificial sequence
  Synthetic oligonucleotide
agtcctcaaagattggaacaaca

SEQ ID NO: 97 - DNA, 23 bp, Artificial sequence
  Synthetic oligonucleotide
atcttccctcaaagattggaaca

SEQ ID NO: 98 - DNA, 23 bp, Artificial sequence
  Synthetic oligonucleotide
cccaattggcggtacaccaaatt

SEQ ID NO: 99 - DNA, 23 bp, Artificial sequence
  Synthetic oligonucleotide
cttcatcaaggtactgtttgatc

SEQ ID NO: 100 - DNA, 23 bp, Artificial sequence
  Synthetic oligonucleotide
gaattcaaaagaaaaacacaagg

SEQ ID NO: 101 - DNA, 23 bp, Artificial sequence
  Synthetic oligonucleotide
gaattcaaaagaaaaacataagg

SEQ ID NO: 102 - DNA, 23 bp, Artificial sequence
  Synthetic oligonucleotide
gcttgtaatggtggctccgcctc

SEQ ID NO: 103 - DNA, 23 bp, Artificial sequence
  Synthetic oligonucleotide
agggaagatgaaacagtagtacc

SEQ ID NO: 104 - DNA, 23 bp, Artificial sequence
  Synthetic oligonucleotide
cactatccacgtggtatggttgc

SEQ ID NO: 105 - DNA, 23 bp, Artificial sequence
  Synthetic oligonucleotide
cagcaaaataatgcacttttcaa

SEQ ID NO: 106 - DNA, 23 bp, Artificial sequence
  Synthetic oligonucleotide
cagcaaataatgcatttttcatc

SEQ ID NO: 107 - DNA, 23 bp, Artificial sequence
  Synthetic oligonucleotide
cgctacccacgtggtttggtttc

SEQ ID NO: 108 - DNA, 23 bp, Artificial sequence
  Synthetic oligonucleotide
cttgtgagcttcaacaatgaaaa

SEQ ID NO: 109 - DNA, 23 bp, Artificial sequence
  Synthetic oligonucleotide
gaaaataattttctcaagtaccc

SEQ ID NO: 110 - DNA, 23 bp, Artificial sequence
  Synthetic oligonucleotide
gagtaccgccaattagggcaacc

SEQ ID NO: 111 - DNA, 23 bp, Artificial sequence
  Synthetic oligonucleotide
tgattacctaccaataccataat

SEQ ID NO: 112 - DNA, 23 bp, Artificial sequence
  Synthetic oligonucleotide
tgattacctaccaataccatata

SEQ ID NO: 113 - DNA, 19 bp, Artificial sequence
  Synthetic oligonucleotide
caaagggacgaagtggtgg

SEQ ID NO: 114 - DNA, 19 bp, Artificial sequence
  Synthetic oligonucleotide
caaagggacgaagtggtgg

SEQ ID NO: 115 - DNA, 6242 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 116 - DNA, 6245 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttatttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 117 - DNA, 6247 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 118 - DNA, 6076 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 119 - DNA, 6248 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 120 - DNA, 6238 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 121 - DNA, 5997 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaataaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 122 - DNA, 5071 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatatacccgaaaacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 123 - DNA, 6248 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagaaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 124 - DNA, 6240 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 125 - DNA, 5071 bp, Artificial sequence; identical to SEQ ID NO: 122
  Synthetic polynucleotide

SEQ ID NO: 126 - DNA, 6248 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagtgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 127 - DNA, 6221 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaaccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 128 - DNA, 5901 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccatcttctaaactgtgcaaaaaagggtacttgagaaaattattttccaaatagatgtagctgtttaagagggatatttccatgacactactaattattaaaaacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 129 - DNA, 6147 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 130 - DNA, 6246 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 131 - DNA, 6187 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgactttttggtactccaaattttcgggtatatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 132 - DNA, 6237 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 133 - DNA, 6248 bp, Artificial sequence; identical to SEQ ID NO: 119
  Synthetic polynucleotide

SEQ ID NO: 134 - DNA, 5904 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 135 - DNA, 6191 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataaacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 136 - DNA, 6243 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcagatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 137 - DNA, 6234 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgcccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 138 - DNA, 6245 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctcgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 139 - DNA, 6003 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 140 - DNA, 5517 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 141 - DNA, 5905 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccacgtgggtagcgcaaagcataaaaacgtgtctataagatcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 142 - DNA, 6245 bp, Artificial sequence; identical to SEQ ID NO: 116
  Synthetic polynucleotide

SEQ ID NO: 143 - DNA, 5559 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 144 - DNA, 6142 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaatcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

SEQ ID NO: 145 - DNA, 6251 bp, Artificial sequence
  Synthetic polynucleotide
aatccgcatcattttattttctcaacgtgataaatttaaaatgaatagaaacgaaccacataaaagtataaactgttattatcctactctgaagatgttacgaattgattggaatagattcggttaggttctgatgtgggttttttagaattgagaaaacatgggcaaaaacataaaaagttacactacgagtacgggggaaatgaatttgttgagcctaccatttaatggtaactttggaggacagagcccatccagctgccatttaatatctctcttaacatacgaaagccccgtccaactttagtaatagtatacaagaagaacattgggctcgggctcgggctcaggaaattgaacaagaccctaaaatgagcattgtaggctgtctgacctaacttttgattggacatagatagatgttaaacgagacacacactaaggagacagaaaccaaacccacattggaaaaatcatcaacagcacctgtttgcatacatctaaattaaaaattctaatgaattttacataaggaacaagggattaattctcaagatttctcatcgttcaaaaaggttttgaagaaggattcgtattttaaaccaattacatgtgctgaaatctcgcacccacttccacattaaaattatgtcgttacaaaatgcgatctatcaattggggagagcaaacatttagcatccgtttttcttttgtattatgaagaattgcttttcaaaagtataataattatgtattttcaaaaataaaaactcaaaatatattttaatactttttataaattcaaactaaagataattaaaatttaaaatttattaataaagttatgtttttttatgtttaaacaaatatgcaattgccgtactaaaataaaaacaaataagcaattatttttaacgatattttgttggcctacgaattagttttgtgattacctaccaataccataatcattgtagaacccgcgaatggcataataataatgcacaacaaaggccccgaccaacctatctatttttctttaaagaaaagccttgtgtttttcttttgaattcgaaaagccgcatgttaaatatagcacttattctgaaataatatacggtccaataataattcaatagatcatttacactcgtgattaaggataaggagaataaagtacaaaaattttaaacataatcatttcaatatattatctactttattttttagctcttgactttaatttattttgacttgaatattaaactgcaaatatctttatccttctgcagaacttaataggccatcattataaaaaaaaataaaaaaaatcagcacactctcccgaatctgcaagatatgtgatgactttcttctaaacttgtgcaaaaaagggtacttgagaaaattattttccaaataagtgtagttgtttaagaggggatatatttccatgacactactaactattaaaagtttaggaatatttttgagtgagaaataaaaaaaaatgtaactaatgtaaggtttgaaagtagtcaaaattgtagaataaagtagactagtgtgttgaaaagtgcattattttgctgcaaactcgcagtcacctttcttctcatatatttttttaggaagacaagaagacattagctgccatttttgaaagttttatgcaataatataacacgtaataataactcagcagagcatagcagaaaagaaaggtgtgtgaaaaagaaatctaaatggattattatttgatttgaagttgccaaacataacgagatttttatcccttccttgttttcttagaaaggacaataaaccaaaaagtctgatatacccgaaaatttggagtaccgccaattagggcaaccataccacgtggatagtgcaaagcatagaaacgtatccaaaaagaactgtagcaatcatcacaacacaaccaaggctacgacttaaagcaaccgcaatattttggccaaaagtcacaaattactacacgcatctaaattctaaacactcctccgacctataatacccttttctattttcattgttgaagctcacaagcaaaggctaaagtagattagattctcctcaagcaaaacctagagctcccacactcctccactacttagaatattaaaagccccttccttcatcaaggtactactgtttcatcttccctcaaagattggaacaacaacaggaacatgggtactctaacaactgttcctgtgctcccttctaagcttaacaagccttcgctttctccgcgtcacaattctctttttccctactacggaagacgcgtcgggaagaagaacaaagcaatggttcctgtatgtgcttcttttcttttcttaagtttttttttttttatcaacatttatcgttgttgggtttgtctgatgggtttggttgggaattggatcaggttgctaggttgttcgggccagccatatttgaagcctcaaagcttaaggttttattcttaggagtggacgaaaataaacacccaggaaatctcccaaggacttatactctaacccatagtgatataaccgctaagctcaccttggcaatctctcaaaccataaataattctcaggtatttttcatctttgatcttacaattttgttttcctattcttttggaatcgttgttgagcaaaaatttagtggaaaagaagatgcagatgttgtcacaaaacagaggaaatcagggtatcttacaacattcttgctgtgtaagagaacattttttgggccaaaagggtaggaaatcatgatagatggtaacatgtgaatcatactgccgaccaattagatgggtgcttggttgaattcattgaattttattctgtagaaatagtcgtttgagaaagtgattattttgcataattaatttgatacgcaagacccacggaaataggaacggattgttcaacactccaacctggtagaaaatgaatccttgtaagtccaaaatgtgtgtttgacttttgtaaactcccaacctaaaattggtgattgtaaattgtgtttgtttaccaataataatatattttggaaaatcataataaaattgtatttgtacatgatttgagtcaaatcatggtttagaagttccataaacctaataaattgtgtttttgcaaatcattatgaaaacactaataagtagggcaatggtcacaattaatttagcaattggcttaaagtaacctcttttttattttcaatttctaattgcaatcatgagattcctgaacatattatttgtgaatgaaaccacctagtttacaaagttcaaactgaggaaaataaacatgggaattgaattgcagttacaggggtggtacaacagattgcaaagggacgaagtggtggcacagtggaagaaggtgaagggaaagatgtctctgcacgtacactgccacatcagtggtggtcattttctcttagatatattagcaaggttacgatacttcatcttctgcaaggagctaccagtggtaagatagttttgcttgcaagtatctaattataatctctcactctgattggtcaatgaatgaaaaataaaacggaacatgtgttgctattgcgtgtgttaattaggtgttgaaggcggtggttcacggcgacgaaaacctattcaacaactacccagaattgcaagatgccttggtttgggtttactttcactcaaacattccagaattcaacaaggtggaatgttggggcccactgaaggaagcgtcagcaccaataggtggggccaaggaagagagtgagcaagaaactcttctaagtaaggagggcttggcaattccacagccatgccaagaggaatgcgaatgttgctttccaccgctgacgttaagcccaattcagtggtctcaacaagttcccagccaccattacgaaccttgtgatgggattgagacccaacaaagtctataaacttccaaactatcatacacagaaaagaaaaaaaataaaatcacatcacagttacagggatgctggcaaattcatatgccatttccctgtatacatcattaggacaaatcaaatattcaaaacccatttcaatgtaaataaggaagctcgtatttgcaaaaaaaaaaaattaactttctttgttatgatttttctttcgtaagaaattaaattagttcatgtataatatttctgtgtgcatgattatatctaagaattaaacagaattttttttttaggaatggaagttctatttatatatactcttatagctagattttcgtggttgtaatattgttttctcagtttcgtagtttcttttgcgtgataatttttaggattttcagtcaagtaaacttgtttgcaaaagggcgacgacaaaagtttgacacgctcagtttaaaaatatttaaatataagattgagatgtttgaattaagatttaagatggtattctgccgtagaagagaacattcaagaatgctggtgatcataataactaatatggaagaaaaggccaaaacagtgttcaataacgttattttacgagttatcttttgtctctacatatttatctatctaaatgaaatattatattctttttggtttaaaaatataaaactagttatcttgataaaagaaaaaaggttaaattactcatttctttctttcttataatttcatgatttttatttttttagttcctataatttgataagtgatttttttagtctttataatttacattttaaggattaaaaaaatctaaaaaaatcacttttaaatgtaaacgatgggtactgactaatttaaccaagaaaaaaaaaaaaactcaactaaggggtgagtatatatgggttcggacttattgactgtccgtttcacccgtaaattaaaacggcttaagattaattaaatgttggtgtacatttaaatgtagcctttttcgttgatgtattagaccctattcacggactcattatactttttgaatattatttattattttgtaattttattgacatgtgtatttgagactggaaacacactgaagtctcactttcaaaagtaatagagatgatgagagataaaaaaaaatgtgtaaagaatattgttaagaaataaactttgttggtatatataaaactttaatttgtcaatctattatttttaagcttgtcgtattagcaaaagttaataaatattctctagttcttaaattaattataattaaatcaatcaataaattataattaataaaatcaatataattatgaataaaaaaatgaatataattcaatagcaataataaaatataagagaaaaatgttaaaaagaaaataattacacttgattattttgttttgaaaaagaaagattacaattatctctataatgaatgttattaaaaatatgatatttataaataaaaaaagaggggaaaatatcattgccttcacaatgtttatacaagaaaatatttttttcataaaaaataagaaaattaaataaaattcaattattattattacaactatgccttacataaatccgtcactgcctcgcattcagagttattatttattagttcctaacttgaccaagaaaaggcgactgaaatattttttaagaaaaattgtaaataactgtaatattttctattaagtaaggacgtttagaaaaaacttataaaaaaaccattatattttattttatcattaaacaagaaagttgaaatttgaagctatttaattaacttcgttaaaataatttataactttttttataaggttttttactttattttaataaggtttatgatgaatctgatgaaaataaatttatggaattaaataattttgacataaactctcaagttcttttttagaataaataagttcttattaaattagtacttaagttgtttagttaggaacaaatttatatactcaaccttgagaatatgctaattaaagaaaataaaaaaaaaatatgtactataagtttagttatgattatttttttaagaaaatgacagtttttttctcaataaaatttgattataaaaatatttgaaatactaaataagctaattcgaatagacatgttattttaaaattggtatggcatcatggtgaaggatcgataaatttttgggtcggtcgagagacttgaattggcactccccactgggcaatgaattgaaatgtgcagtcttgcagtgtaaacacttgttgctt

SEQ ID NO: 146 - DNA, 6253 bp, Artificial sequence
  Synthetic polynucleotide
attctttgtgattaattaaagtttattgaaaattattaattttgataaattttgtttctcatttaatataaatcaagaaaaagaaacattaagaaataaaatctacaaaattaatgatttttaataaattttaatcaatggccataaataataaaattgcataaaccaagcccacatttgaaaaatcatcaagagcgcctgtttgcatacatctaaattaaaaattctagtgaattttacataagaaacaacagattaattcttgacatttcttatcgttccaaaatgttttgaattttaaaacaattattacatgtgctgaaatctcacacccagcacttccacattaaaattagaagagtataagtcacattctctctatattctttatgattgattataatttattaaaaatcaatcattttgatagactttatttcttatttaatataaatcaggaaaaagaaatattaattgagaaacaaaacctaccaaatgattttcaatagattctaataaatcacataaaaagtatccaaaagaaagtataaaaaaaaattaaaaactcaaaataaaatatttagcatctgttttttttttgtattatgaagaaatacttctaaagaataaaaatatacatccaaaattataataattatgaaatttaaaagaaaaactcaaaatatattttaatacttttttataaattaaaaaaaaattgaaatttaaaatttaaaacttataaataaaattgtttttttttaagtttaaacaaataatccaactgtcgtaccaaaagaaaaacaaataagaaattatttttaacaatatttcaatggcctatgaattagttttgtgattacctaccaataccatataatttctttagaacccgtgaatggcataataataatgcacaacaaaggccccgaccaaccgatctatttttctttaaagaaaagccttatgtttttcttttgaattcgaaaagccacatgttaaatatagcccttgttctgaaatagtatacgctccaatgaaaattcagtagatcatttacacttgtaattaaggattaaggacgaggagaataaagtataaaaataaaaatcttaaacataatcatttcaaggtattatttactttattttattttgacttgaacattaaattgcaaatatctttatcctttgcagaacttatttggccatcattaaaagaatcagcacactctcccgaatctccaagatacgtaatgactttcttctaaactgtgcaaaaaagggtacttgagaaaattattttccaaatagatgtagctgtttaagagggatatttccatgacactactaattattaaaatttttgtaatattttttagtgacaaataaaaaaatgtaaggtttgaatgtagtcaaaattgtagaataaagtaaactactatgatgaaaaatgcattatttgctgcaaactcgcaatcacctttctacccatagtaaatttttgaggaagacaagaagacagtagctgccatttttgagagtcttaaaaataattcatagttagtaataatataacacgtaataataaccacaaaagaaacgtgtacgaaaagaaatctaaatgaattatcatttgattttcaagttgttaagctccacttttttttttgtttctttttgttgtaattacattttttttatgtataaaattcaaaatatgatactttagttaaagagattaaatttaataatactgaaatcaattaattgttgattacaaaactgcactctacaaaggagatttttatcccttccttgttcttgttcttgaaaggaaaataaaaccaaaaaagtctggtatacccggaaatttggtgtaccgccaattggggaaaccaaaccacgtgggtagcgcaaagcataaaaacgtgtctataagaggcggagccaccattacaagcgaaagtatccaaaaataaataaataaaattgtagcaatcacaacacaaccaaggctacgacttaaagcaaccgcaatcttttggccaaaagtcacacacacattactacacgcatctaaacactcctccgaactataatacagttttcttattttcattgttgaagctcacaagcaaaggctaaagtagattctattctcctcaagcaaaacctatagctcccccacactcctccagtacttgaataaaagctaaataaatattaaagcctttccttcatcaaggtactgtttgatctttgaatttcagtcctcaaagattggaacaacaggaacatgtgtactctcacaactgttcctgtgctcccttctaagcttaacaagccttcgctttctccgcaccacaattctctttttccctactgtggaagacgggtcgggaagaagaacaaagcaatggttcctgtatgtgtttcttttcttttcttctgagtttttttttttattttttatcaacatttattgttgttgtgtttgtctcatgggtttgtttggaattgatcaggttgcaaggttgttcgggccagccatatttgaagcctcaaaactgaaggttttgttcttaggagtggacgaaaataaacacccaggaaatctcccaaggacttatacgctaacccatagtgatataaccgctaagctcaccttggcaatctctcaaaccataaataattctcaggtatgtggttttgatctttcaattttgttttcctattctttcggaatcgttgttaagaaaaaaaattggtggaggagaggatgcaaattttgtcacaaaacagaggaaatcagggtatcttacattcttgcggtgtaagagaacattttttgggccaaaagggtaggaactcataatagatggtaacatgtgaatcatactgccgaccaaattaacatgttagatgggtgtttggttgaattcattgaatttattctggagaaatagtcttattttattttattttcagttgtttgaaaaaattaaaataaaacaaaaaagtgattattttgcataatctgatacgaaacacccactacgagagaggggaaataggatcggattgcccaacactccaatccggtagaaaatgaatctttttaagtccaaactgtgtgtttgacttatgatttgtaacctcccaacctaaaattggaaagtgtaaattgtgtttgtttaccaattatgatatattttagtgactcataataaagttgtatttgaacttgaatttgggtaaaatcatggtttagaagttgttccataaacccaaattgtgtttttttgggtttttgcaaaagacataattaaggagcgaagttgtcatatgatttaaggaatgaacatgggaattgaattgcagctgcaggggtggtacaacagatttcaaagggacgaagtggtggcacagtggaaaaaggtgaagggaaggatgtctctgcacgttcactgccacattagtggaggtcattttctcttggatatattagcaaggttaagatacttcatcttctgcaaggagctaccagtggtaagctacttttgcttgcaagcatcaaattatggtttgtttcactgactggtcaatgaatgaaaaattaaacgcaacatgtttcctattgcgtgtgtaaattaggtgttgaaggccgtcgttcacggcgatgaaaacctattcaacagctacccagaattgcaagatgccttggtttgggtctactttcactcaaacattccagaattcaacaaggtggaatgttggggcccactgaaggaagcgtcagcacccacaggtggggtccaggaggaggggttggcaattccacagccatgccaagaagaatgccaatgttgctttccaccgcttacgttgagccctattcagtggtctaaacaagttcccagccgccattacgaaccttgtgatgggattgggacccaacaaaatctataaacagccaaactactacaattcacagttacggggatgctgccaaattggcaaattccctgtatacaaattaaatattcgaaacccatttcaatgtaaataaggaagctcgtatttgcaatttttttttttttatatatttttctttactttctttgttatgatttttctttcgtaagaaattaaattagttcatgtataatatgtctgtatgcatggttatttcaaagaattaaacagatttttgtaaggagtggaatttcgtggttgtaatattgttttctcagtttcgttgtttcttttgcgttataatttttagagattttaagtcgagaaaacttggttgaaaaaggacaacgacaaatgttagacacgctaagtttaaaatatttaaatttaagattgagatgtttgaattaagatgctattctgccgtggaagacaacattcaaaaatgctggtgatgatagtaaccaacaaggaagaaaaggccaaaacaatgtacaataacgttattttgcaagttattttttttcctacatatttatctacctaaatgaaatattatatttttttccggtttaaaaatataaaatcagttatcttgaataaaagaaaaagaaattgaactaaggggtgtgttcttaagactataaagtagaaacacacaaaagcccctgcctcgcattcagagatgagatgagatagtctcattattagttcctgacttgaccaagaaatgagtgcatggattgacttcatcaagaacacggctaatgtaaaattgtaaggcgagtgatatatatatatatatatatatatatatatatatatatatatatatatatatataacattgtagatgactgaaatatttttctatcaagtaaggacgtttagaaaaacttatataacacaattatattttattttataattaaacagttaagttgaagtttaaagctatttaattatcgtcataaaataatttataaggttttttttacttaggtttatgatgaaacttatgagaataaatttattgaattaaacaattttgacataagctctcaagttccatttttagaataaataagttcttattaaaatagtatttgttaagttgtttaattaggaacaaatttatataatcagccttgacaatatgctaattaaagaaaataagaaaatatgtatgtgtttagttatgattagttttttttaacaaaaaatgacagctttctttctcaataaaatttgattataaaattatttggaatactaaataagctaattcaaattcacacgttattttaaaattggtatggcatcatggtgaaggataaatttgtaggtcggttgagagacttcaatgggcactgccactcgctaagcaaagacaatgaattgaaatgtgcagtcctgcagtgtaaacacttgtgcttaccacaaaattgatagcatattattggttattgttaaatgtatagatagatgcggatattatcgtttcaatcggtgtatatatgtggctacccagattatgcttttgctatctagaggaatatggacaaattcacacttacgagtgtttccgtgcaaaaacacttgctccaactaaaagaaccacgtttcaaccgcgttgaggaattccaatatcaaccagcaaatcaagtagcgatttttttttcttttcccactgcaactgcaaaaatcacagagccagtttagctgacacaagttcatgttaatctctgtttaactaacacagtttatctatcggcatagcctattaaggcggtttggttggttgaagcagaggatattattcttggattggattggatcgaatttctcattctattttgtttgcttttctattcttttatcgtattcggttgttctgttctgggagaggcaaagtgccaatattattgggcagacagaattacagggctcaacaccaatgaccaaaccactggactagctagttcttcaagtgtgtggtaggtaagtattaaacagcacgttttagttgtgacattagcaaaagtctcattccttgaagcaatgaagagtcaagaccactcttgcctcaccaataatggtttacataagacacggtcgaatgatgtcctcatattgctgatgcccacacttgacacttgagtgaggggcagtagccacttttcagtaactagtaattcaaaatttagtttcaccttcaattcacagtgtagtattagaagagtactttaaccacctatcaggatcggtctaatgac

That which is claimed is:

1. A soybean plant or plant part thereof comprising at least one non-natural mutation in each of an endogenous STAYGREEN1 (SGR1) gene that encodes an SGR1 protein and an endogenous STAYGREEN2 (SGR2) gene that encodes an SGR2 protein, wherein the at least one non-natural mutation is in the untranslated region or the promoter region of the endogenous SGR gene, and the at least one non-natural mutation in the SGR1 gene results in the nucleic acid sequence of any one of SEQ ID NOs:116, 119, 121, 124, 128, 129, 132, 135, 138, 139, 141, 142 or 144 and the at least one non-natural mutation in the SGR2 gene results in the nucleic acid sequence of any one of SEQ ID NOs:115, 117, 118, 120, 122, 125, 126, 127, 130, 131, 134, 136, 137, 140, or 143; and wherein the soybean plant or part thereof comprising the at least one non-natural mutation in the endogenous SGR1 gene and in the endogenous SGR2 gene exhibits an increase in resistance to soybean rust, delayed senescence and/or chlorophyll retention as compared to a control soybean plant or part thereof not comprising the at least one non-natural mutation in the endogenous SGR1 gene and in the endogenous SGR2 gene.

2. A soybean plant cell comprising at least one non-natural mutation in each of an endogenous STAYGREEN1 (SGR1) gene and an endogenous STAYGREEN2 (SGR2) gene, wherein the at least one non-natural mutation is introduced into the untranslated region or the promoter region of the endogenous SGR gene and the endogenous SGR2 gene using an editing system that comprises a nucleic acid binding domain that binds to a target site in the endogenous SGR1 gene and/or the endogenous SGR2 gene, and the at least one non-natural mutation in the SGR1 gene results in the nucleic acid sequence of any one of SEQ ID NOs:116, 119, 121, 124, 128, 129, 132, 135, 138, 139, 141, 142 or 144 and the at least one non-natural mutation in the SGR2 gene results in the nucleic acid sequence of any one of SEQ ID NOs:115, 117, 118, 120, 122, 125, 126, 127, 130, 131, 134, 136, 137, 140, or 143; and wherein a plant regenerated from the soybean cell and comprising the at least one non-natural mutation in the endogenous SGR1 gene and in the endogenous SGR2 gene exhibits an increase in resistance to soybean rust, delayed senescence and/or chlorophyll retention as compared to a control soybean plant not comprising the at least one non-natural mutation in the endogenous SGR1 gene and in the endogenous SGR2 gene.

* * * * *

UNITED STATES PATENT AND TRADEMARK OFFICE
CERTIFICATE OF CORRECTION

| | | |
|---|---|---|
| PATENT NO. | : 11,882,808 B2 | Page 1 of 1 |
| APPLICATION NO. | : 17/212686 | |
| DATED | : January 30, 2024 | |
| INVENTOR(S) | : Marisa Miller | |

It is certified that error appears in the above-identified patent and that said Letters Patent is hereby corrected as shown below:

In the Specification

Column 6, Line 16: Please insert a paragraph break between "infection" and "FIG. 7"

Column 7, Line 27: Please correct "10%" to read --±10%--

Column 55, Line 64: Please correct "of strength" to read --of ½ strength--

In the Claims

Column 60, Line 38, Claim 2: Please correct "SGR gene" to read --SGR1 gene--

Signed and Sealed this
Twenty-sixth Day of November, 2024

Katherine Kelly Vidal
*Director of the United States Patent and Trademark Office*